US012760308B2

(12) United States Patent
Cantley et al.

(10) Patent No.: US 12,760,308 B2
(45) Date of Patent: Oct. 13, 2026

(54) COMPOSITIONS AND METHODS FOR SILENCING SCN9A EXPRESSION

(71) Applicant: ALNYLAM PHARMACEUTICALS, INC., Cambridge, MA (US)

(72) Inventors: William Cantley, Cambridge, MA (US); James D. McIninch, Burlington, MA (US); Adam Castoreno, Framingham, MA (US); Charalambos Kaittanis, Cambridge, MA (US); Mark K. Schlegel, Lexington, MA (US)

(73) Assignee: ALNYLAM PHARMACEUTICALS, INC., Cambridge, MA (US)

( * ) Notice: Subject to any disclaimer, the term of this patent is extended or adjusted under 35 U.S.C. 154(b) by 866 days.

(21) Appl. No.: 17/995,699

(22) PCT Filed: Apr. 6, 2021

(86) PCT No.: PCT/US2021/025956

§ 371 (c)(1),
(2) Date: Oct. 6, 2022

(87) PCT Pub. No.: WO2021/207189

PCT Pub. Date: Oct. 14, 2021

(65) Prior Publication Data

US 2023/0159933 A1 May 25, 2023

Related U.S. Application Data

(60) Provisional application No. 63/161,313, filed on Mar. 15, 2021, provisional application No. 63/006,328, filed on Apr. 7, 2020.

(51) Int. Cl.

| | |
|---|---|
| ***C12N 15/113*** | (2010.01) |
| ***A61K 31/713*** | (2006.01) |
| ***A61K 45/06*** | (2006.01) |

(52) U.S. Cl.

CPC ........ *C12N 15/1138* (2013.01); *A61K 31/713* (2013.01); *A61K 45/06* (2013.01); *C12N 2310/14* (2013.01); *C12N 2310/3125* (2013.01); *C12N 2310/315* (2013.01); *C12N 2310/321* (2013.01); *C12N 2310/3515* (2013.01); *C12N 2310/3525* (2013.01); *C12N 2320/31* (2013.01)

(58) Field of Classification Search

CPC ............ C12N 15/1138; C12N 2310/14; C12N 2310/3125; C12N 2310/315; C12N 2310/321; C12N 2310/3525; C12N 2310/322; C12N 2310/3231; A61K 31/713

See application file for complete search history.

(56) References Cited

U.S. PATENT DOCUMENTS

| | | | |
|---|---|---|---|
| 3,228,831 | A | 1/1966 | Nicholson et al. |
| 3,687,808 | A | 8/1972 | Merigan, Jr. et al. |
| 3,904,682 | A | 9/1975 | Fried et al. |
| 4,009,197 | A | 2/1977 | Fried et al. |
| 4,469,863 | A | 9/1984 | Ts'O et al. |
| 4,476,301 | A | 10/1984 | Imbach et al. |
| 4,587,044 | A | 5/1986 | Miller et al. |
| 4,605,735 | A | 8/1986 | Miyoshi et al. |
| 4,667,025 | A | 5/1987 | Miyoshi et al. |
| 4,683,202 | A | 7/1987 | Mullis |
| 4,762,779 | A | 8/1988 | Snitman |
| 4,789,737 | A | 12/1988 | Miyoshi et al. |
| 4,824,941 | A | 4/1989 | Gordon et al. |
| 4,828,979 | A | 5/1989 | Klevan et al. |
| 4,835,263 | A | 5/1989 | Nguyen et al. |
| 4,837,028 | A | 6/1989 | Allen |
| 4,845,205 | A | 7/1989 | Huynh Dinh et al. |
| 4,876,335 | A | 10/1989 | Yamane et al. |
| 4,897,355 | A | 1/1990 | Eppstein et al. |
| 4,904,582 | A | 2/1990 | Tullis |
| 4,948,882 | A | 8/1990 | Ruth |
| 4,958,013 | A | 9/1990 | Letsinger |
| 4,981,957 | A | 1/1991 | Lebleu et al. |
| 5,023,243 | A | 6/1991 | Tullis |
| 5,034,506 | A | 7/1991 | Summerton et al. |
| 5,082,830 | A | 1/1992 | Brakel et al. |
| 5,109,124 | A | 4/1992 | Ramachandran et al. |
| 5,112,963 | A | 5/1992 | Pieles et al. |
| 5,118,800 | A | 6/1992 | Smith et al. |
| 5,118,802 | A | 6/1992 | Smith et al. |
| 5,130,302 | A | 7/1992 | Spielvogel et al. |
| 5,134,066 | A | 7/1992 | Rogers et al. |

(Continued)

FOREIGN PATENT DOCUMENTS

| | | | |
|---|---|---|---|
| CN | 109536493 | A | 3/2019 |
| CN | 110536895 | A | 12/2019 |

(Continued)

OTHER PUBLICATIONS

Baker, Mark D., and Mohammed A. Nassar. "Painful and painless mutations of SCN9A and SCN11A voltage-gated sodium channels." Pflügers Archiv-European Journal of Physiology 472 (2020): 865-880.*

(Continued)

*Primary Examiner* — Kimberly Chong

(74) *Attorney, Agent, or Firm* — Womble Bond Dickinson (US) LLP

(57) ABSTRACT

The disclosure relates to double-stranded ribonucleic acid (dsRNA) compositions targeting SCN9A, and methods of using such dsRNA compositions to alter (e.g., inhibit) expression of SCN9A.

18 Claims, 12 Drawing Sheets

Specification includes a Sequence Listing.

(56) References Cited

U.S. PATENT DOCUMENTS

| | | | |
|---|---|---|---|
| 5,138,045 | A | 8/1992 | Cook et al. |
| 5,166,315 | A | 11/1992 | Summerton et al. |
| 5,171,678 | A | 12/1992 | Behr et al. |
| 5,175,273 | A | 12/1992 | Bischofberger et al. |
| 5,177,195 | A | 1/1993 | Gregory et al. |
| 5,185,444 | A | 2/1993 | Summerton et al. |
| 5,188,897 | A | 2/1993 | Suhadolnik et al. |
| 5,214,134 | A | 5/1993 | Weis et al. |
| 5,214,136 | A | 5/1993 | Lin et al. |
| 5,216,141 | A | 6/1993 | Benner |
| 5,218,105 | A | 6/1993 | Cook et al. |
| 5,235,033 | A | 8/1993 | Summerton et al. |
| 5,245,022 | A | 9/1993 | Weis et al. |
| 5,254,469 | A | 10/1993 | Warren, III et al. |
| 5,258,506 | A | 11/1993 | Urdea et al. |
| 5,262,536 | A | 11/1993 | Hobbs, Jr. |
| 5,264,423 | A | 11/1993 | Cohen et al. |
| 5,264,562 | A | 11/1993 | Matteucci |
| 5,264,564 | A | 11/1993 | Matteucci |
| 5,272,250 | A | 12/1993 | Spielvogel et al. |
| 5,276,019 | A | 1/1994 | Cohen et al. |
| 5,278,302 | A | 1/1994 | Caruthers et al. |
| 5,283,185 | A | 2/1994 | Epand et al. |
| 5,286,717 | A | 2/1994 | Cohen et al. |
| 5,292,873 | A | 3/1994 | Rokita et al. |
| 5,317,098 | A | 5/1994 | Shizuya et al. |
| 5,319,080 | A | 6/1994 | Leumann |
| 5,321,131 | A | 6/1994 | Agrawal et al. |
| 5,359,044 | A | 10/1994 | Cook et al. |
| 5,367,066 | A | 11/1994 | Urdea et al. |
| 5,371,241 | A | 12/1994 | Brush |
| 5,391,723 | A | 2/1995 | Priest |
| 5,393,878 | A | 2/1995 | Leumann |
| 5,399,676 | A | 3/1995 | Froehler |
| 5,405,938 | A | 4/1995 | Summerton et al. |
| 5,405,939 | A | 4/1995 | Suhadolnik et al. |
| 5,414,077 | A | 5/1995 | Lin et al. |
| 5,416,203 | A | 5/1995 | Letsinger |
| 5,432,272 | A | 7/1995 | Benner |
| 5,434,257 | A | 7/1995 | Matteucci et al. |
| 5,445,934 | A | 8/1995 | Fodor et al. |
| 5,446,137 | A | 8/1995 | Maag et al. |
| 5,451,463 | A | 9/1995 | Nelson et al. |
| 5,453,496 | A | 9/1995 | Caruthers et al. |
| 5,455,233 | A | 10/1995 | Spielvogel et al. |
| 5,457,187 | A | 10/1995 | Gmeiner et al. |
| 5,459,255 | A | 10/1995 | Cook et al. |
| 5,466,677 | A | 11/1995 | Baxter et al. |
| 5,466,786 | A | 11/1995 | Buhr et al. |
| 5,470,967 | A | 11/1995 | Huie et al. |
| 5,476,925 | A | 12/1995 | Letsinger et al. |
| 5,484,908 | A | 1/1996 | Froehler et al. |
| 5,486,603 | A | 1/1996 | Buhr |
| 5,489,677 | A | 2/1996 | Sanghvi et al. |
| 5,502,177 | A | 3/1996 | Matteucci et al. |
| 5,510,475 | A | 4/1996 | Agrawal et al. |
| 5,512,439 | A | 4/1996 | Hornes et al. |
| 5,512,667 | A | 4/1996 | Reed et al. |
| 5,514,785 | A | 5/1996 | Van Ness et al. |
| 5,519,126 | A | 5/1996 | Hecht |
| 5,519,134 | A | 5/1996 | Acevedo et al. |
| 5,525,465 | A | 6/1996 | Haralambidis et al. |
| 5,525,711 | A | 6/1996 | Hawkins et al. |
| 5,536,821 | A | 7/1996 | Agrawal et al. |
| 5,539,082 | A | 7/1996 | Nielsen et al. |
| 5,541,307 | A | 7/1996 | Cook et al. |
| 5,541,313 | A | 7/1996 | Ruth |
| 5,541,316 | A | 7/1996 | Engelskirchen et al. |
| 5,543,152 | A | 8/1996 | Webb et al. |
| 5,545,730 | A | 8/1996 | Urdea et al. |
| 5,550,111 | A | 8/1996 | Suhadolnik et al. |
| 5,552,538 | A | 9/1996 | Urdea et al. |
| 5,552,540 | A | 9/1996 | Haralambidis |
| 5,561,225 | A | 10/1996 | Maddry et al. |
| 5,563,253 | A | 10/1996 | Agrawal et al. |
| 5,565,552 | A | 10/1996 | Magda et al. |
| 5,567,810 | A | 10/1996 | Weis et al. |
| 5,567,811 | A | 10/1996 | Misiura et al. |
| 5,571,799 | A | 11/1996 | Tkachuk et al. |
| 5,574,142 | A | 11/1996 | Meyer, Jr. et al. |
| 5,576,427 | A | 11/1996 | Cook et al. |
| 5,578,717 | A | 11/1996 | Urdea et al. |
| 5,578,718 | A | 11/1996 | Cook et al. |
| 5,580,731 | A | 12/1996 | Chang et al. |
| 5,585,481 | A | 12/1996 | Arnold, Jr. et al. |
| 5,587,361 | A | 12/1996 | Cook et al. |
| 5,587,371 | A | 12/1996 | Sessler et al. |
| 5,587,469 | A | 12/1996 | Cook et al. |
| 5,591,584 | A | 1/1997 | Chang et al. |
| 5,591,722 | A | 1/1997 | Montgomery et al. |
| 5,594,121 | A | 1/1997 | Froehler et al. |
| 5,595,726 | A | 1/1997 | Magda et al. |
| 5,596,086 | A | 1/1997 | Matteucci et al. |
| 5,596,091 | A | 1/1997 | Switzer |
| 5,597,696 | A | 1/1997 | Linn et al. |
| 5,597,909 | A | 1/1997 | Urdea et al. |
| 5,599,923 | A | 2/1997 | Sessler et al. |
| 5,599,928 | A | 2/1997 | Hemmi et al. |
| 5,602,240 | A | 2/1997 | De Mesmaeker et al. |
| 5,608,046 | A | 3/1997 | Cook et al. |
| 5,610,289 | A | 3/1997 | Cook et al. |
| 5,610,300 | A | 3/1997 | Altmann et al. |
| 5,614,617 | A | 3/1997 | Cook et al. |
| 5,618,704 | A | 4/1997 | Sanghvi et al. |
| 5,623,070 | A | 4/1997 | Cook et al. |
| 5,625,050 | A | 4/1997 | Beaton et al. |
| 5,627,053 | A | 5/1997 | Usman et al. |
| 5,633,360 | A | 5/1997 | Bischofberger et al. |
| 5,639,873 | A | 6/1997 | Barascut et al. |
| 5,646,265 | A | 7/1997 | Mcgee |
| 5,658,873 | A | 8/1997 | Bertsch-Frank et al. |
| 5,663,312 | A | 9/1997 | Chaturvedula |
| 5,670,633 | A | 9/1997 | Cook et al. |
| 5,677,195 | A | 10/1997 | Winkler et al. |
| 5,677,437 | A | 10/1997 | Teng et al. |
| 5,677,439 | A | 10/1997 | Weis et al. |
| 5,681,941 | A | 10/1997 | Cook et al. |
| 5,688,941 | A | 11/1997 | Cook et al. |
| 5,700,920 | A | 12/1997 | Altmann et al. |
| 5,705,188 | A | 1/1998 | Junichi et al. |
| 5,714,331 | A | 2/1998 | Buchardt et al. |
| 5,719,262 | A | 2/1998 | Buchardt et al. |
| 5,744,305 | A | 4/1998 | Fodor et al. |
| 5,750,692 | A | 5/1998 | Cook et al. |
| 5,770,722 | A | 6/1998 | Lockhart et al. |
| 5,854,033 | A | 12/1998 | Lizardi |
| 5,874,219 | A | 2/1999 | Rava et al. |
| 5,976,567 | A | 11/1999 | Wheeler et al. |
| 5,981,501 | A | 11/1999 | Wheeler et al. |
| 6,015,886 | A | 1/2000 | Dale et al. |
| 6,028,188 | A | 2/2000 | Arnold, Jr. et al. |
| 6,054,299 | A | 4/2000 | Conrad |
| 6,124,445 | A | 9/2000 | Imbach et al. |
| 6,147,200 | A | 11/2000 | Manoharan et al. |
| 6,160,109 | A | 12/2000 | Just et al. |
| 6,166,197 | A | 12/2000 | Cook et al. |
| 6,169,170 | B1 | 1/2001 | Gryaznov et al. |
| 6,172,209 | B1 | 1/2001 | Manoharan et al. |
| 6,191,105 | B1 | 2/2001 | Ekwuribe et al. |
| 6,222,025 | B1 | 4/2001 | Cook et al. |
| 6,235,887 | B1 | 5/2001 | Froehler et al. |
| 6,239,265 | B1 | 5/2001 | Cook |
| 6,268,490 | B1 | 7/2001 | Imanishi et al. |
| 6,277,603 | B1 | 8/2001 | Cook |
| 6,294,664 | B1 | 9/2001 | Ravikumar et al. |
| 6,320,017 | B1 | 11/2001 | Ansell |
| 6,326,199 | B1 | 12/2001 | Cook et al. |
| 6,346,614 | B1 | 2/2002 | Metelev et al. |
| 6,380,368 | B1 | 4/2002 | Froehler et al. |
| 6,444,423 | B1 | 9/2002 | Meade et al. |
| 6,525,191 | B1 | 2/2003 | Ramasamy |
| 6,528,640 | B1 | 3/2003 | Beigelman et al. |
| 6,531,590 | B1 | 3/2003 | Manoharan et al. |
| 6,534,484 | B1 | 3/2003 | Wheeler et al. |

(56) References Cited

U.S. PATENT DOCUMENTS

| | | | | |
|---|---|---|---|---|
| 6,534,639 | B1 | 3/2003 | Manoharan et al. | |
| 6,576,752 | B1 | 6/2003 | Manoharan et al. | |
| 6,586,410 | B1 | 7/2003 | Wheeler et al. | |
| 6,608,035 | B1 | 8/2003 | Agrawal et al. | |
| 6,617,438 | B1 | 9/2003 | Beigelman et al. | |
| 6,639,062 | B2 | 10/2003 | Manoharan et al. | |
| 6,670,461 | B1 | 12/2003 | Wengel et al. | |
| 6,683,167 | B2 | 1/2004 | Metelev et al. | |
| 6,747,014 | B2 | 6/2004 | Teng et al. | |
| 6,770,748 | B2 | 8/2004 | Imanishi et al. | |
| 6,783,931 | B1 | 8/2004 | Cook et al. | |
| 6,794,499 | B2 | 9/2004 | Wengel et al. | |
| 6,815,432 | B2 | 11/2004 | Wheeler et al. | |
| 6,858,225 | B2 | 2/2005 | Semple et al. | |
| 6,858,715 | B2 | 2/2005 | Ravikumar et al. | |
| 6,867,294 | B1 | 3/2005 | Sanghvi et al. | |
| 6,878,805 | B2 | 4/2005 | Manoharan et al. | |
| 6,887,906 | B1 | 5/2005 | Teng et al. | |
| 6,900,297 | B1 | 5/2005 | Cook et al. | |
| 6,998,484 | B2 | 2/2006 | Koch et al. | |
| 7,015,315 | B1 | 3/2006 | Cook et al. | |
| 7,034,133 | B2 | 4/2006 | Wengel et al. | |
| 7,037,646 | B1 | 5/2006 | Cook et al. | |
| 7,041,816 | B2 | 5/2006 | Ravikumar et al. | |
| 7,045,610 | B2 | 5/2006 | Dempcy et al. | |
| 7,053,207 | B2 | 5/2006 | Wengel | |
| 7,063,860 | B2 | 6/2006 | Chancellor et al. | |
| 7,070,802 | B1 | 7/2006 | Bhalani et al. | |
| 7,084,125 | B2 | 8/2006 | Wengel | |
| RE39,464 | E | 1/2007 | Cook et al. | |
| 7,157,099 | B2 | 1/2007 | Autuori et al. | |
| 7,273,933 | B1 | 9/2007 | Krotz et al. | |
| 7,321,029 | B2 | 1/2008 | Gryaznov et al. | |
| 7,399,845 | B2 | 7/2008 | Seth et al. | |
| 7,427,605 | B2 | 9/2008 | Davis et al. | |
| 7,427,672 | B2 | 9/2008 | Imanishi et al. | |
| 7,495,088 | B1 | 2/2009 | Brakel et al. | |
| 7,569,686 | B1 | 8/2009 | Bhat et al. | |
| 7,626,014 | B2 | 12/2009 | Manoharan et al. | |
| 7,741,457 | B2 | 6/2010 | Seth et al. | |
| 7,858,769 | B2 | 12/2010 | Jadhav et al. | |
| 8,022,193 | B2 | 9/2011 | Seth et al. | |
| 8,030,467 | B2 | 10/2011 | Seth et al. | |
| 8,058,069 | B2 | 11/2011 | Yaworski et al. | |
| 8,090,542 | B2 * | 1/2012 | Khvorova .......... | C12N 15/1135 435/6.1 |
| 8,101,348 | B2 | 1/2012 | Tuschl et al. | |
| 8,106,022 | B2 | 1/2012 | Manoharan et al. | |
| 8,158,601 | B2 | 4/2012 | Chen et al. | |
| 8,278,283 | B2 | 10/2012 | Seth et al. | |
| 8,278,425 | B2 | 10/2012 | Prakash et al. | |
| 8,278,426 | B2 | 10/2012 | Seth et al. | |
| 8,314,227 | B2 | 11/2012 | Wengel | |
| 11,084,844 | B2 * | 8/2021 | Prakash ............... | C12N 15/113 |
| 2003/0027780 | A1 | 2/2003 | Hardee et al. | |
| 2004/0171570 | A1 | 9/2004 | Allerson et al. | |
| 2005/0244858 | A1 | 11/2005 | Rossi et al. | |
| 2006/0094061 | A1 | 5/2006 | Brys et al. | |
| 2008/0039618 | A1 | 2/2008 | Allerson et al. | |
| 2009/0012281 | A1 | 1/2009 | Swayze et al. | |
| 2010/0173973 | A1 | 7/2010 | Brown | |
| 2010/0273857 | A1 | 10/2010 | Thakker et al. | |
| 2010/0324120 | A1 | 12/2010 | Chen et al. | |
| 2011/0313020 | A1 | 12/2011 | Templin et al. | |
| 2012/0157511 | A1 | 6/2012 | Manoharan et al. | |
| 2013/0011922 | A1 | 1/2013 | Quay et al. | |
| 2013/0096289 | A1 | 4/2013 | Wengel | |
| 2013/0190383 | A1 | 7/2013 | Vaish et al. | |
| 2016/0264966 | A1 | 9/2016 | Fitzgerald et al. | |

FOREIGN PATENT DOCUMENTS

| | | |
|---|---|---|
| JP | 2020-506686 A | 3/2020 |
| WO | WO 1988/04924 | 7/1988 |
| WO | WO 1991/16024 | 10/1991 |
| WO | WO 1993/24640 | 12/1993 |
| WO | WO 1994/00569 | 1/1994 |
| WO | WO 1994/02595 | 2/1994 |
| WO | WO 1996/37194 | 11/1996 |
| WO | WO 1996/40964 | 12/1996 |
| WO | WO 1997/13499 | 4/1997 |
| WO | WO 1997/30731 | 8/1997 |
| WO | WO 1998/39359 | 9/1998 |
| WO | WO 1999/14226 | 3/1999 |
| WO | WO 2000/03683 | 1/2000 |
| WO | WO 2000/22114 | 4/2000 |
| WO | WO 2007/091269 | 8/2007 |
| WO | WO 2007/117686 | 10/2007 |
| WO | WO 2008/042973 | 4/2008 |
| WO | WO 2009/014887 | 1/2009 |
| WO | WO 2009/033027 | 3/2009 |
| WO | WO 2009/088891 | 7/2009 |
| WO | WO 2009/088892 | 7/2009 |
| WO | WO 2009/127060 | 10/2009 |
| WO | WO 2009/132131 | 10/2009 |
| WO | WO 2010/011895 | 1/2010 |
| WO | WO 2010/054406 | 5/2010 |
| WO | WO 2010/088537 | 8/2010 |
| WO | WO 2010/129709 | 11/2010 |
| WO | WO 2010/141511 | 12/2010 |
| WO | WO 2011/005861 | 1/2011 |
| WO | WO 2011/031520 | 3/2011 |
| WO | WO 2011/133876 | 10/2011 |
| WO | WO 2012/177906 | 12/2012 |
| WO | WO 2013/036868 | 3/2013 |
| WO | WO 2013/075035 | 5/2013 |
| WO | WO 2014/179620 | 11/2014 |
| WO | WO 2014/179627 | 11/2014 |
| WO | WO 2015/116658 | 8/2015 |
| WO | WO 2019/055633 | 3/2019 |
| WO | WO 2019/217459 | 11/2019 |
| WO | 2018/138585 A1 | 12/2019 |
| WO | WO 2000/22113 | 4/2022 |

OTHER PUBLICATIONS

Kelley et al. ("Association of small-fiber polyneuropathy with three previously unassociated rare missense SCN9A variants." Canadian Journal of Pain 4.1 (2020): 19-29).*

Vega-Loza, Andrea, et al. "Gene therapies to reduce chronic pain: are we there yet?." Pain Management 10.4 (2020): 209-212.*

Sciabola et al. ("PFRED: A computational platform for siRNA and antisense oligonucleotides design." PLoS One 16.1 (2021)).*

Official Action issued Feb. 21, 2024 in Eurasian patent application No. 202292838, including translation.

Official Action issued Jan. 3, 2025 in Taiwan patent application No. 110112410, including translation.

Aigner, "Delivery Systems for the Direct Application of siRNAs to Induce RNA Interference (RNAi) In Vivo," J. Biomed. Biotechnol., 2006, 2006:71659, 15 pp.

Akaneya et al., "RNAi-Induced Gene Silencing by Local Electroporation in Targeting Brain Region," J. Neurophysiol., 2005, 93:594-602.

Akhtar & Juliano, "Cellular uptake and intracellular fate of antisense oligonucleotides," Trends Cell. Biol., 1992, 2(5):139-144.

Allen & Chonn, "Large unilamellar liposomes with low uptake into the reticuloendothelial system," FEBS Letters, 1987, 223(1):42-46.

Aoki et al., "Potential tumor-targeting peptide vector of histidylated oligolysine conjugated to a tumor-homing RGD motif," Cancer Gene Therapy, 2001, 8(10):783-787.

Arnold et al., "Specific beta1-adrenergic receptor silencing with small interfering RNA lowers high blood pressure and improves cardiac function in myocardial ischemia," J. Hypertens., 2007, 25(1):197-205.

Bangham et al., "Diffusion of Univalent lons Across the Lamellae of Swollen Phospholipids," J. Mol. Biol., 1965, 13:238-252.

Bernstein et al., "Role for a bidentate ribonuclease in the initiation step of RNA interference," Nature, 2001, 409:363-366.

(56) References Cited

OTHER PUBLICATIONS

Bitko et al., "Inhibition of respiratory viruses by nasally administered siRNA," Nat. Med., 2005, 11:50-55; published online Dec. 26, 2004.
Bonnet et al., "Systemic Delivery of DNA or siRNA Mediated by Linear Polyethylenimine (L-PEI) Does Not Induce an Inflammatory Response," Pharm. Res., 2008, 25(12):2972-2982; Epub Aug. 16, 2008.
Buur et al., "Penetration of 5-Fluorouracil and Prodrugs Across the Intestine of the Albino Rabbit: Evidence for Shift in Absorption Site from the Upper to the Lower Region of the Gastrointestinal Tract by Prodrugs," J. Control Rel., 1990, 14:43-51.
Chien et al., "Novel cationic cardiolipin analogue-based liposome for efficient DNA and small interfering RNA delivery in vitro and in vivo," Cancer Gene Ther., 2005, 12:321-328.
Chu & Rana, "Potent RNAi by short RNA triggers," RNA, 2008, 14:1714-1719.
Constantinides et al., "Formulation and Intestinal Absorption Enhancement Evaluation of Water-in-Oil Microemulsions Incorporating Medium-Chain Glycerides," Pharmaceutical Research, 1994, 11(10):1385-1390.
Couture & Stinchcomb, "Anti-gene therapy: the use of ribozymes to inhibit gene function," Trends in Genetics, 1996, 12(12):510-515.
Crooke et al., "Pharmacokinetic Properties of Several Novel Oligonucleotide Analogs in mice," J. Pharmacol. Exp. Ther., 1996, 277:923-937.
Dansie and Turk, "Assessment of patients with chronic pain," Br J Anaesth, 2013, 111(1):19-25.
Dorn et al., "siRNA relieves chronic neuropathic pain," Nucleic Acids, 2004, 32:e49, 6 pp.
Du Plessis et al., "Topical delivery of liposomally encapsulated gamma-interferon," Antiviral Research, 1992, 18:259-265.
Elbashir et al., "Functional anatomy of siRNAs for mediating efficient RNAi in *Drosophila melanogaster* embryo lysate," EMBO J., 2001, 20(23):6877-6888.
Elbashir et al., "RNA interference is mediated by 21-and 22-nucleotide RNAs," Genes Dev., 2001, 15:188-200.
El-Hariri et al., "The Mitigating Effects of Phosphatidylcholines on Bile Salt- and Lysophosphatidylcholine-induced Membrane Damage," J. Pharm. Pharmacol., 1992, 44:651-654.
Elmén et al., "Locked nucleic acid (LNA) mediated improvements in siRNA stability and functionality," Nucleic Acids Research, 2005, 33(1):439-447.
Felgner et al., "Lipofection: A highly efficient, lipid-mediated DNA-transfection procedure," Proc. Natl. Acad. Sci. USA, 1987, 84:7413-7417.
Felgner et al., "Enhanced Gene Delivery and Mechanism Studies with a Novel Series of Cationic Lipid Formulations," J. Biol. Chem., 1994, 269(4):2550-2561.
Fluiter et al., "Filling the gap in LNA antisense oligo gapmers: the effects of unlocked nucleic acid (UNA) and 4'-C-hydroxymethyl-DNA modifications on RNase H recruitment and efficacy of an LNA gapmer," Mol. Biosyst., 2009, 5:838-843.
Fukunaga et al., "Liposome Entrapment Enhances the Hypocalcemic Action of Parenterally Administered Calcitonin," Endocrinol., 1984, 115(2):757-761.
Gabizon & Papahadjopoulos, "Liposome formulations with prolonged circulation time in blood and enhanced uptake by tumors," Proc. Natl. Acad. Sci. USA, 1988, 85:6949-6953.
Gao et al, "A Novel Cationic Liposome Reagent for Efficient Transfection of Mammalian Cells," Biochim. Biophys. Res. Commun., 1991, 179(1):280-285.
Gassmann et al., "Maintenance of an extrachromosomal plasmid vector in mouse embryonic stem cells," Proc. Natl. Acad. Sci. USA, 1995, 92:1292-1296.
Gene ID: 6335, "SCN9A sodium voltage-gated channel alpha subunit 9 [ *Homo sapiens* (human) ]," Jul. 9, 2023.
Gershon et al., "Mode of Formation and Structural Features of DNA-Cationic Liposome Complexes Used for Transfection," Biochem., 1993, 32:7143-7151.
Grünweller et al., "Comparison of different antisense strategies in mammalian cells using locked nucleic acids, 2'-O-methyl RNA, phosphorothioates and small interfering RNA," Nucleic Acids Research, 2003, 31(12):3185-3193.
Guatelli et al., "Isothermal, in vitro amplification of nucleic acids by a multienzyme reaction modeled after retroviral replication," Proc. Natl. Acad. Sci. USA, 1990, 87:1874-1878.
Haubner et al., "Glycosylated RGD-Containing Peptides: Tracer for Tumor Targeting and Angiogenesis Imaging with Improved Biokinetics," J Nucl Med, 2001, 42:326-336.
Ho et al., "Preparation of Microemulsions Using Polyglycerol Fatty Acid Esters as Surfactant for the Delivery of Protein Drugs," J. Pharm. Sci., 1996, 85(2):138-143.
Howard et al., "RNA Interference in Vitro and in Vivo Using a Chitosan/siRNA Nanoparticle System," Mol. Ther., 2006, 14(4):476-484.
Hu et al., "Topical delivery of cyclosporin A from non-ionic liposomal systems : an in vivo/in vitro correlation study using hairless mouse skin," S.T.P. Pharma. Sci., 1994, 4(6):466-469.
Itani et al., "A simple and efficient liposome method for transfection of DNA into mammalian cells grown in suspension," Gene, 1987, 56:267-276.
Jarrett, "Affinity chromatography with nucleic acid polymers," Chromatogr., 1993, 618:315-339.
Jensen et al., "Unlocked nucleic acid (UNA) and UNA derivatives: Thermal denaturation studies," Nuc. Acids Symp. Series, 2008, 52(1):133-134.
Kabanov et al., "A new class of antivirals: antisense oligonucleotides combined with a hydrophobic substituent effectively inhibit influenza virus reproduction and synthesis of virus-specific proteins in MDCK cells," FEBS Lett., 1990, 259(2):327-330.
Kim et al., "Preparation of Multivesicular Liposomes," Biochim. Biophys. Acta, 1983, 728:339-348.
Kim et al., "Synthetic dsRNA Dicer substrates enhance RNAi potency and efficacy," Nat Biotech, 2005, 23(2):222-226.
Kim et al., "Cholesteryl Oligoarginine Delivering Vascular Endothelial Growth Factor siRNA Effectively Inhibits Tumor Growth in Colon Adenocarcinoma," Mol. Ther., 2006, 14(3):343-350.
Kim et al., "Local and systemic delivery of VEGF siRNA using polyelectrolyte complex micelles for effective treatment of cancer," Journal of Controlled Release, 2008, 129:107-116.
Kubo et al., "Chemically modified symmetric and asymmetric duplex RNAs: an enhanced stability to nuclease degradation and gene silencing effect," Biochem. Biophys. Res. Comm., 2008, 365:54-61; available online Oct. 29, 2007.
Kwoh et al., "Transcription-based amplification system and detection of amplified human immunodeficiency virus type 1 with a bead-based sandwich hybridization format," Proc. Natl. Acad. Sci. USA, 1989, 86:1173-1177.
Lam et al., "A new type of synthetic peptide library for identifying ligand-binding activity," Nature, 1991, 354:82-84.
Lee et al., "Mucosal Penetration Enhancers For Facilitation of Peptide and Protein Drug Absorption," Critical Reviews in Therapeutic Drug Carrier Systems, 1991, 8(2):91-192.
Letsinger et al., "Cholesteryl-conjugated oligonucleotides: Synthesis, properties, and activity as inhibitors of replication of human immunodeficiency virus in cell culture," Proc. Natl. Acid. Sci. USA, 1989, 86:6553-6556.
Li et al., "Polyethylenimine-complexed Plasmid Particles Targeting Focal Adhesion Kinase Function as Melanoma Tumor Therapeutics," Mol. Ther., 2007, 15(3):515-523.
Lima et al., "Single-Stranded siRNAs Activate RNAi in Animals," Cell, 2012, 150:883-894.
Liu, "Radiolabeled Multimeric Cyclic RGD Peptides as Integrin $\alpha v\beta 3$ Targeted Radiotracers for Tumor Imaging," Mol. Pharm., 2006, 3(5):472-487.
Lizardi et al., "Exponential Amplification of Recombinant-RNA Hybridization Probes," Bio/Technology, 1988, 6:1197-1202.
Makimura et al., "Reducing hypothalamic AGRP by RNA interference increases metabolic rate and decreases body weight without influencing food intake," BMC Neurosci., 2002, 3:18, 6 pp.
Mannino & Gould-Fogerite, "Liposome Mediated Gene Transfer," Biotechniques, 1988, 6(7):682-690.

(56) References Cited

OTHER PUBLICATIONS

Manoharan et al., "Chemical Modifications to Improve Uptake and Bioavailability of Antisense Oligonucleotides," Ann. N.Y. Acad. Sci., 1992, 660:306-309.
Manoharan et al., "Introduction of a Lipophilic Thioether Tether in the Minor Groove of Nucleic Acids for Antisense Applications," Biorg. Med. Chem. Let., 1993, 3(12):2765-2770.
Manoharan et al., "Cholic Acid-Oligonucleotide Conjugates for Antisense Applications," Biorg. Med. Chem. Let., 1994, 4(8):1053-1060.
Manoharan et al., "Lipidic Nucleic Acids," Tetrahedron Lett., 1995, 36(21):3651-3654.
Manoharan et al., "Oligonucleotide Conjugates: Alteration of the Pharmacokinetic Properties of Antisense Agents," Nucleosides & Nucleotides, 1995, 14(3-5):969-973.
Martin et al., "A New Access to 2'-O-alkylated Ribonucleosides and Properties of 2'-O-Alkylated Oligoribonucleotides," Helv. Chim. Acta, 1995, 78:486-504 (including machine translation).
Mayer et al., "Vesicles of variable sizes produced by a rapid extrusion procedure," Biochim. Biophys. Acta, 1986, 858:161-168.
Mayhew et al., "Characterization of Liposomes Prepared by Using a Microemulsifier," Biochim. Biophys. Acta, 1984, 775:169-174.
Mcnamara et al., "Cell type-specific delivery of siRNAs with aptamer-siRNA chimeras," Nat. Biotechnol., 2006, 24(8):1005-1015.
Mikhailov et al., "Synthesis of a New Class of Acyclic 2',5'- and 3',5'-Oligonucleotide Analogs Based on 9-[1,5-dihydroxy-4(S)-hydroxymethyl-3-oxapent-2(R)-yl]-adenine," Tetrahedron Letters, 1985, 26(17):2059-2062.
Mishra et al., "Improved leishmanicidal effect of phosphorotioate antisense oligonucleotides by LDL-mediated delivery," Biochim. Biophys. Acta, 1995, 1264:229-237.
Mook et al., "Evaluation of locked nucleic acid-modified small interfering RNA in vitro and in vivo," Mol Canc Ther, 2007, 6(3):833-843.
Muranishi, "Absorption Enhancers," Critical Reviews in Therapeutic Drug Carrier Systems, 1990, 7(1):1-33.
Nabel et al., "Direct gene transfer wit DNA-liposome complexes in melanoma: Expression, biologic activity, and lack of toxicity in humans," Proc. Natl. Acad. Sci. USA, 1993, 90:11307-11311.
Nabel et al., "Gene Transfer In Vivo with DNA-Liposome Complexes: Lack of Autoimmunity and Gonadal Localization," Human Gene Ther., 1992, 3:649-656.
NCBI Reference Sequence: NM_001365536.1, "*Homo sapiens* sodium voltage-gated channel alpha subunit 9 (SCN9A), transcript variant 2, mRNA," Jul. 5, 2023.
NCBI Reference Sequence: NM_002977.3, "*Homo sapiens* sodium voltage-gated channel alpha subunit 9 (SCN9A), transcript variant 1, mRNA," Jul. 3, 2023.
Nicolau et al., "Liposomes as Carriers for in Vivo Gene Transfer and Expression," Meth. Enzymol., 1987, 149:157-176.
Nielsen et al., "Sequence-Selective Recognition of DNA by Strand Displacement with a Thymine-Substituted Polyamide," Science, 1991, 254(5037):1497-1500.
Nykänen et al., "ATP Requirements and Small Interfering RNA Structure in the RNA Interference Pathway," Cell, 2001, 107(3):309-321.
Oberhauser & Wagner, "Effective incorporation of 2'-O-methyl-oligoribonucleotides into liposomes and enhanced cell association through modification with thiocholesterol," Nucl. Acids Res., 1992, 20(3):533-538.
Olson et al., "Preparation of liposomes of defined size distribution by extrusion through polycarbonate membranes," Biochim. Biophys. Acta, 1979, 557(1):9-23.
Pal et al., "Systemic delivery of RafsiRNA using cationic cardiolipin liposomes silences Raf-1 expression and inhibits tumor growth in xenograft model of human prostate cancer," Int J. Oncol., 2005, 26:1087-1091.
Papahadjopoulos & Gabizon, "Targeting of Liposomes to Tumor Cells in Vivo," Ann. N.Y. Acad. Sci., 1987, 507(1):64-74.
Pillé et al., "Anti-RhoA and Anti-RhoC siRNAs Inhibit the Proliferation and Invasiveness of MDA-MB-231 Breast Cancer Cells in Vitro and in Vivo," Mol. Ther., 2005, 11(2):267-274.
Reich et al., "Small interfering RNA (siRNA) targeting VEGF effectively inhibits ocular neovascularization in a mouse model," Mol. Vis., 2003, 9:210-216.
Ritschel, "Microemulsions for Improved Peptide Absorption from the Gastrointestinal Tract," Meth. Find. Exp. Clin. Pharmacol., 1991, 13(3):205-220.
Saison-Behmoaras et al., "Short modified antisense oligonucleotides directed against Ha-ras point mutation induce selective cleavage of the mRNA and inhibit T24 cells proliferation," EMBO J, 1991, 10(5):1111-1118.
Sharp, "RNA interference—2001," Genes Dev., 2001, 15:485-490.
Shea et al., "Synthesis, hybridization properties and antiviral activity of lipid-oligodeoxynucleotide conjugates," Nucl. Acids Res., 1990, 18(13):3777-3783.
Shishkina et al., "Attenuation of α2A-Adrenergic Receptor Expression in Neonatal Rat Brain by RNA Interference or Antisense Oligonucleotide Reduced Anxiety in Adulthood," Neuroscience, 2004, 129:521-528.
Simeoni et al., "Insight into the mechanism of the peptide-based gene delivery system MPG: implications for delivery of siRNA into mammalian cells," Nucl. Acids Res., 2003, 31(11):2717-2724.
Sørensen et al., "Gene Silencing by Systemic Delivery of Synthetic siRNAs in Adult Mice," J. Mol. Biol., 2003, 327:761-766.
Soutschek et al., "Therapeutic silencing of an endogenous gene by systemic administration of modified siRNAs," Nature, 2004, 432:173-178.
Straubinger & Papahadjopoulos, "Liposomes as Carriers for Intracellular Delivery of Nucleic Acids," Meth. Enzymol., 1983, 101:512-527.
Strauss & Jaenisch, "Molecular complementation of a collagen mutation in mammalian cells using yeast artificial chromosomes," EMBO J., 1992, 11(2):417-422.
Svinarchuk et al., "Inhibition of HIV proliferation in MT-4 cells by antisense oligonucleotide conjugated to lipophilic groups," Biochimie, 1993, 75:49-54.
Szoka & Papahadjopoulos, "Procedure for preparation of liposomes with large internal aqueous space and high capture by reverse-phase evaporation," Proc. Natl. Acad. Sci., 1978, 75(9):4194-4198.
Takahashi et al., "The Use of a Perfluorochemical Emulsion as a Vascular Perfusate in Drug Absorption," J. Pharm. Pharmacol., 1988, 40:252-257.
Tan et al., "Gene knockdown with intrathecal siRNA of NMDA receptor NR2B subunit reduces formalin-induced nociception in the rat," Gene Ther., 2005, 12:59-66.
Tetko et al., "Prediction of n-Octanol/Water Partition Coefficients from PHYSPROP Database Using Artificial Neural Networks and E-State Indices," J. Chem. Inf. Comput. Sci., 2001, 41:1407-1421.
Thakker et al., "Neurochemical and behavioral consequences of widespread gene knockdown in the adult mouse brain by using nonviral RNA interference," Proc. Natl. Acad. Sci. U.S.A., 2004, 101(49):17270-17275.
Tolentino et al., "Intravitreal Injection of Vascular Endothelial Growth Factor Small Interfering RNA Inhibits Growth and Leakage in a Nonhuman Primate, Laser-Induced Model of Choroidal Neovascularization," Retina, 2004, 24(1):132-138.
Tomalia et al., "Dendrimers as multi-purpose nanodevices for oncology drug delivery and diagnostic imaging," Biochem. Soc. Trans., 2007, 35(1):61-67.
Verma et al., "Small Interfering RNAs Directed against-Catenin Inhibit the in Vitro and in Vivo Growth of Colon Cancer Cells," Clin. Cancer Res., 2003, 9:1291-1300.
Wang & Huang, "pH-sensitive immunoliposomes mediate target-cell-specific delivery and controlled expression of a foreign gene in mouse," Proc. Natl Acad. Sci. USA, 1987, 84:7851-7855.
Wang & Huang, "Plasmid DNA Adsorbed to pH-sensitive Liposomes Efficiently Transforms the Target Cells," Biochem. Biophys. Res. Commun., 1987, 147(3):980-985.
Weiner et al., "Liposomes: A Novel Topical Delivery System for Pharmaceutical and Cosmetic Applications," Journal of Drug Targeting, 1994, 2:405-410.

(56) References Cited

OTHER PUBLICATIONS

Wu et al., "Increased Microvascular Permeability Contributes to Preferential Accumulation of Stealth Liposomes in Tumor Tissue," Cancer Research, 1993, 53:3765-3770.
Yamamoto et al., "A Mechanistic Study on Enhancement of Rectal Permeability to Insulin in the Albino Rabbit," J. Pharm. Exp. Ther., 1992, 263(1):25-31.
Yamashita et al., "Effects of diclofenac sodium and disodium ethylenediaminetetraacetate on electrical parameters of the mucosal membrane and their relation to the permeability enhancing effects in the rat jejunum," J. Pharm. Pharmacol., 1987, 39:621-626.
Yamashita et al., "Effect of Adjuvants on Charge-Selective Permeability and Electrical Resistance of Rat Jejunal Membrane," J. Pharm. Sci., 1990, 79(7):579-583.
Yoo et al., "PAMAM Dendrimers as Delivery Agents for Antisense Oligonucleotides," Pharm. Res., 1999, 16:1799-1804.
Zhang et al., "Small Interfering RNA Targeting Heme Oxygenase-1 Enhances Ischemia-Reperfusion-induced Lung Apoptosis," J. Biol. Chem., 2004, 279(11):10677-10684.
Zhou et al., "Lipophilic polylysines mediate efficient DNA transfection in mammalian cells," Biochim. Biophys. Acta, 1991, 1065:8-14.
Zhou & Huang, "Targeted delivery of DNA by liposomes and polymers," Journal of Controlled Release, 1992, 19:269-274.
Zhou et al., "Fine Tuning of Electrostatics around the Internucleotidic Phosphate through Incorporation of Modified 2',4'-Carbocyclic-LNAs and -ENAs Leads to Significant Modulation of Antisense Properties," J. Org. Chem., 2009, 74:118-134.
Zimmermann et al., "RNAi-mediated gene silencing in non-human primates," Nature, 2006, 441:111-114.
Zitzmann et al., "Arginine-glycine-aspartic acid (RGD)-peptide binds to both tumor and tumor endothelial cells in vivo.," Cancer Res., 2002, 62:5139-5143.
Meguro et al., "Function and role of voltage-gated sodium channel NaV1.7 expressed in aortic smooth muscle cells," Am J Physiol Heart Circ Physiol, 2009, 296:H211-H219.
Official Action issued Apr. 8, 2025 in Japanese patent application No. 2022-561136, including English translation.
International Search Report and Written Opinion issued Sep. 2, 2021 in PCT/US2021/025956.
Official Action issued Dec. 16, 2025 in Japanese patent application No. 2022-561136, including translation.
Official Action issued Nov. 27, 2025 in Taiwan patent application No. 110112410, including translation.
Official Action issued Jan. 29, 2026 in Chinese Patent Application No. 202180043529X, including translation.

* cited by examiner

*indicates parents not screened in this study

COMPOSITIONS AND METHODS FOR SILENCING SCN9A EXPRESSION

RELATED APPLICATIONS

This application claims priority to U.S. provisional application No. 63/006,328, filed on Apr. 7, 2020, and U.S. provisional application No. 63/161,313, filed on Mar. 15, 2021. The entire contents of the foregoing applications are hereby incorporated herein by reference.

SEQUENCE LISTING

The instant application contains a Sequence Listing which has been submitted electronically in ASCII format and is hereby incorporated by reference in its entirety. Said ASCII copy, created on Apr. 2, 2021, is named A2038-7235WO_SL.txt and is 1,514,568 bytes in size.

FIELD OF THE DISCLOSURE

The disclosure relates to the specific inhibition of the expression of the SCN9A gene.

BACKGROUND

Pain, e.g., chronic pain is a prevalent symptom and major cause of disability. Chronic pain can result from inflammatory pain or neuropathic pain, or it can be associated with a disease or disorder, e.g., cancer, arthritis, diabetes, traumatic injury and/or viral infections. Hypersensitivity or hyposensitivity to pain can also result from pain-related disorders, including but not limited to an inability to sense pain, primary erythromelalgia (PE), and paroxysmal extreme pain disorder (PEPD). Current therapies for pain are non-selective for their targets and result in unwanted, off-target effects involving the central nervous system (CNS). New treatments for pain, e.g., chronic pain and pain-related disorders are needed.

SUMMARY

The present disclosure describes methods and iRNA compositions for modulating the expression of SCN9A. In certain embodiments, expression of SCN9A is reduced or inhibited using an SCN9A-specific iRNA. Such inhibition can be useful in treating disorders related to SCN9A expression, such as pain, e.g., acute pain or chronic pain (e.g., inflammatory pain, neuropathic pain, pain hypersensitivity, pain hyposensitivity, inability to sense pain, primary erythromelalgia (PE), paroxysmal extreme pain disorder (PEPD), small fiber neuropathy (SFN), trigeminal neuralgia (TN) and pain associated with e.g., cancer, arthritis, diabetes, traumatic injury and viral infections).

Accordingly, described herein are compositions and methods that effect the RNA-induced silencing complex (RISC)-mediated cleavage of RNA transcripts of SCN9A, such as in a cell or in a subject (e.g., in a mammal, such as a human subject). Also described are compositions and methods for treating a disorder related to expression of SCN9A, such as pain (e.g., acute pain or chronic pain, e.g., inflammatory pain, neuropathic pain, pain hypersensitivity, pain hyposensitivity, inability to sense pain, primary erythromelalgia (PE), paroxysmal extreme pain disorder (PEPD), small fiber neuropathy (SFN), trigeminal neuralgia (TN) and pain associated with, e.g., cancer, arthritis, diabetes, traumatic injury and viral infections).

The iRNAs (e.g., dsRNAs) included in the compositions featured herein include an RNA strand (the antisense strand) having a region, e.g., a region that is 30 nucleotides or less, generally 19-24 nucleotides in length, that is substantially complementary to at least part of an mRNA transcript of SCN9A (e.g., a human SCN9A) (also referred to herein as an "SCN9A-specific iRNA"). In some embodiments, the SCN9A mRNA transcript is a human SCN9A mRNA transcript, e.g., SEQ ID NO: 1 herein.

In some embodiments, the iRNA (e.g., dsRNA) described herein comprises an antisense strand having a region that is substantially complementary to a region of a human SCN9A mRNA. In some embodiments, the human SCN9A mRNA has the sequence NM_002977.3 (SEQ ID NO: 1) or NM_001365536.1 (SEQ ID NO: 4001). In some embodiments, the human SCN9A mRNA has the sequence NM_002977.3 (SEQ ID NO: 1). The sequence of NM_002977.3 is also herein incorporated by reference in its entirety. The reverse complement of SEQ ID NO: 1 is provided as SEQ ID NO: 2 herein. In some embodiments, the human SCN9A mRNA has the sequence NM_001365536.1 (SEQ ID NO: 4001). The sequence of NM_001365536.1 is also herein incorporated by reference in its entirety. The reverse complement of SEQ ID NO: 4001 is provided as SEQ ID NO: 4002 herein.

In some aspects, the present disclosure provides a double stranded ribonucleic acid (dsRNA) agent for inhibiting expression of sodium channel, voltage gated, type IX alpha subunit (SCN9A), wherein the dsRNA agent comprises a sense strand and an antisense strand forming a double stranded region, wherein the sense strand comprises a nucleotide sequence comprising at least 15 contiguous nucleotides, with 0, 1, 2, or 3 mismatches, of a portion of a coding strand of human SCN9A and the antisense strand comprises a nucleotide sequence comprising at least 15 contiguous nucleotides, with 0, 1, 2, or 3 mismatches, of the corresponding portion of a non-coding strand of human SCN9A such that the sense strand is complementary to the at least 15 contiguous nucleotides in the antisense strand.

In some aspects, the present disclosure provides a double stranded ribonucleic acid (dsRNA) agent for inhibiting expression of SCN9A, wherein the dsRNA agent comprises a sense strand and an antisense strand forming a double stranded region, wherein the antisense strand comprises a nucleotide sequence comprising at least 15 contiguous nucleotides, with 0, 1, 2, or 3 mismatches, of a portion of nucleotide sequence of SEQ ID NO: 2 such that the sense strand is complementary to the at least 15 contiguous nucleotides in the antisense strand.

In some aspects, the present disclosure provides a human cell or tissue comprising a reduced level of SCN9A mRNA or a level of SCN9A protein as compared to an otherwise similar untreated cell or tissue, wherein optionally the cell or tissue is not genetically engineered (e.g., wherein the cell or tissue comprises one or more naturally arising mutations, e.g., SCN9A), wherein optionally the level is reduced by at least 10%, 15%, 20%, 25%, 30%, 35%, 40%, 45%, 50%, 55%, 60%, 65%, 70%, 75%, 80%, 85%, 90%, or 95%. In some embodiments, the human cell or tissue is a human peripheral sensory neuron (e.g., a peripheral sensory neuron in a dorsal root ganglion, or a nociceptive neuron, e.g., an A-delta fiber or a C-type fiber).

The present disclosure also provides, in some aspects, a cell containing the dsRNA agent described herein.

In some aspects, the present disclosure also provides a pharmaceutical composition for inhibiting expression of a gene encoding SCN9A, comprising a dsRNA agent described herein.

The present disclosure also provides, in some aspects, a method of inhibiting expression of SCN9A in a cell, the method comprising:

(a) contacting the cell with the dsRNA agent described herein, or a pharmaceutical composition described herein; and (b) maintaining the cell produced in step (a) for a time sufficient to obtain degradation of the mRNA transcript of SCN9A, thereby inhibiting expression of the SCN9A in the cell.

The present disclosure also provides, in some aspects, a method of inhibiting expression of SCN9A in a cell, the method comprising:

(a) contacting the cell with the dsRNA agent described herein, or a pharmaceutical composition described herein; and (b) maintaining the cell produced in step (a) for a time sufficient to reduce levels of SCN9A mRNA, SCN9A protein, or both of SCN9A mRNA and protein, thereby inhibiting expression of the SCN9A in the cell.

The present disclosure also provides, in some aspects, a method of inhibiting expression of SCN9A in a cell or a tissue of the central nervous system (CNS), the method comprising:

(a) contacting the cell or tissue with a dsRNA agent that binds SCN9A; and (b) maintaining the cell or tissue produced in step (a) for a time sufficient to reduce levels of SCN9A mRNA, SCN9A protein, or both of SCN9A mRNA and protein, thereby inhibiting expression of SCN9A in the cell or tissue.

The present disclosure also provides, in some aspects, a method of treating a subject diagnosed with SCN9A-associated disorder comprising administering to the subject a therapeutically effective amount of the dsRNA agent described herein or a pharmaceutical composition described herein, thereby treating the disorder.

In any of the aspects herein, e.g., the compositions and methods above, any of the embodiments herein (e.g., below) may apply.

In some embodiments, the coding strand of human SCN9A has the sequence of SEQ ID NO: 1. In some embodiments, the non-coding strand of human SCN9A has the sequence of SEQ ID NO: 2. In some embodiments, the coding strand of human SCN9A has the sequence of SEQ ID NO: 4001. In some embodiments, the non-coding strand of human SCN9A has the sequence of SEQ ID NO: 4002.

In some embodiments, the sense strand comprises a nucleotide sequence comprising at least 15 contiguous nucleotides, with 0, or 1, 2, or 3 mismatches, of the corresponding portion of the nucleotide sequence of SEQ ID NO: 1. In some embodiments, the sense strand comprises a nucleotide sequence comprising at least 15 contiguous nucleotides, with 0, or 1, 2, or 3 mismatches, of the corresponding portion of the nucleotide sequence of SEQ ID NO: 4001.

In some embodiments, the dsRNA agent comprises a sense strand and an antisense strand, wherein the antisense strand comprises a nucleotide sequence comprising at least 17 contiguous nucleotides, with 0, 1, 2, or 3 mismatches, of a portion of nucleotide sequence of SEQ ID NO: 2 such that the sense strand is complementary to the at least 17 contiguous nucleotides in the antisense strand. In some embodiments, the sense strand comprises a nucleotide sequence comprising at least 17 contiguous nucleotides, with 0, or 1, 2, or 3 mismatches, of the corresponding portion of the nucleotide sequence of SEQ ID NO: 1.

In some embodiments, the dsRNA agent comprises a sense strand and an antisense strand, wherein the antisense strand comprises a nucleotide sequence comprising at least 17 contiguous nucleotides, with 0, 1, 2, or 3 mismatches, of a portion of nucleotide sequence of SEQ ID NO: 4002 such that the sense strand is complementary to the at least 17 contiguous nucleotides in the antisense strand. In some embodiments, the sense strand comprises a nucleotide sequence comprising at least 17 contiguous nucleotides, with 0, or 1, 2, or 3 mismatches, of the corresponding portion of the nucleotide sequence of SEQ ID NO: 4001.

In some embodiments, the dsRNA agent comprises a sense strand and an antisense strand, wherein the antisense strand comprises a nucleotide sequence comprising at least 19 contiguous nucleotides, with 0, 1, 2, or 3 mismatches, of a portion of nucleotide sequence of SEQ ID NO: 2 such that the sense strand is complementary to the at least 19 contiguous nucleotides in the antisense strand. In some embodiments, the sense strand comprises a nucleotide sequence comprising at least 19 contiguous nucleotides, with 0, 1, 2, or 3 mismatches, of the corresponding portion of the nucleotide sequence of SEQ ID NO: 1.

In some embodiments, the dsRNA agent comprises a sense strand and an antisense strand, wherein the antisense strand comprises a nucleotide sequence comprising at least 19 contiguous nucleotides, with 0, 1, 2, or 3 mismatches, of a portion of nucleotide sequence of SEQ ID NO: 4002 such that the sense strand is complementary to the at least 19 contiguous nucleotides in the antisense strand. In some embodiments, the sense strand comprises a nucleotide sequence comprising at least 19 contiguous nucleotides, with 0, 1, 2, or 3 mismatches, of the corresponding portion of the nucleotide sequence of SEQ ID NO: 4001.

In some embodiments, the dsRNA agent comprises a sense strand and an antisense strand, wherein the antisense strand comprises a nucleotide sequence comprising at least 21 contiguous nucleotides, with 0, 1, 2, or 3 mismatches, of a portion of nucleotide sequence of SEQ ID NO: 2 such that the sense strand is complementary to the at least 21 contiguous nucleotides in the antisense strand. In some embodiments, the sense strand comprises a nucleotide sequence comprising at least 21 contiguous nucleotides, with 0, or 1, 2, or 3 mismatches, of the corresponding portion of the nucleotide sequence of SEQ ID NO: 1.

In some embodiments, the dsRNA agent comprises a sense strand and an antisense strand, wherein the antisense strand comprises a nucleotide sequence comprising at least 21 contiguous nucleotides, with 0, 1, 2, or 3 mismatches, of a portion of nucleotide sequence of SEQ ID NO: 4002 such that the sense strand is complementary to the at least 21 contiguous nucleotides in the antisense strand. In some embodiments, the sense strand comprises a nucleotide sequence comprising at least 21 contiguous nucleotides, with 0, or 1, 2, or 3 mismatches, of the corresponding portion of the nucleotide sequence of SEQ ID NO: 4001.

In some embodiments, the portion of the sense strand is a portion within nucleotides 581-601, 760-780, or 8498-8518 of SEQ ID NO: 4001. In some embodiments, the portion of the sense strand is a portion corresponding to SEQ ID NO: 4827, 5026, or 4822.

In some embodiments, the portion of the sense strand is a portion within a sense strand in any one of Tables 2A, 2B, 4A, 4B, 5A, 5B, 6A, 6B, 13A, 13B, 14A, 14B, 15A, 15B, 16, 18, and 20.

In some embodiments, the portion of the antisense strand is a portion within an antisense strand in any one of Tables 2A, 2B, 4A, 4B, 5A, 5B, 6A, 6B, 13A, 13B, 14A, 14B, 15A, 15B, 16, 18, and 20.

In some embodiments, the antisense strand comprises a nucleotide sequence comprising at least 15 contiguous nucleotides, with 0, 1, 2, or 3 mismatches, from one of the antisense sequences listed in any one of Tables 2A, 2B, 4A, 4B, 5A, 5B, 6A, 6B, 13A, 13B, 14A, 14B, 15A, 15B, 16, 18, and 20. In some embodiments, the sense strand comprises a nucleotide sequence comprising at least 15 contiguous nucleotides, with 0, 1, 2, or 3 mismatches, from a sense sequence listed in any one of Tables 2A, 2B, 4A, 4B, 5A, 5B, 6A, 6B, 13A, 13B, 14A, 14B, 15A, 15B, 16, 18, and 20 that corresponds to the antisense sequence.

In some embodiments, the antisense strand comprises a nucleotide sequence comprising at least 17 contiguous nucleotides, with 0, 1, 2, or 3 mismatches, from one of the antisense sequences listed in any one of Tables 2A, 2B, 4A, 4B, 5A, 5B, 6A, 6B, 13A, 13B, 14A, 14B, 15A, 15B, 16, 18, and 20. In some embodiments, the sense strand comprises a nucleotide sequence comprising at least 17 contiguous nucleotides, with 0, 1, 2, or 3 mismatches, from a sense sequence listed in any one of Tables 2A, 2B, 4A, 4B, 5A, 5B, 6A, 6B, 13A, 13B, 14A, 14B, 15A, 15B, 16, 18, and 20 that corresponds to the antisense sequence.

In some embodiments, the antisense strand comprises a nucleotide sequence comprising at least 19 contiguous nucleotides, with 0, 1, 2, or 3 mismatches, from one of the antisense sequences listed in any one of Tables 2A, 2B, 4A, 4B, 5A, 5B, 6A, 6B, 13A, 13B, 14A, 14B, 15A, 15B, 16, 18, and 20. In some embodiments, the sense strand comprises a nucleotide sequence comprising at least 19 contiguous nucleotides, with 0, 1, 2, or 3 mismatches, from a sense sequence listed in any one of Tables 2A, 2B, 4A, 4B, 5A, 5B, 6A, 6B, 13A, 13B, 14A, 14B, 15A, 15B, 16, 18, and 20 that corresponds to the antisense sequence.

In some embodiments, the antisense strand comprises a nucleotide sequence comprising at least 21 contiguous nucleotides, with 0, 1, 2, or 3 mismatches, from one of the antisense sequences listed in any one of Tables 2A, 2B, 4A, 4B, 5A, 5B, 6A, 6B, 13A, 13B, 14A, 14B, 15A, 15B, 16, 18, and 20. In some embodiments, the sense strand comprises a nucleotide sequence comprising at least 21 contiguous nucleotides, with 0, 1, 2, or 3 mismatches, from a sense sequence listed in any one of Tables 2A, 2B, 4A, 4B, 5A, 5B, 6A, 6B, 13A, 13B, 14A, 14B, 15A, 15B, 16, 18, and 20 that corresponds to the antisense sequence.

In some embodiments, the sense strand of the dsRNA agent is at least 23 nucleotides in length, e.g., 23-30 nucleotides in length.

In some embodiments, the portion of the sense strand is a portion within a sense strand from a duplex chosen from AD-1251284 (UGUCGAGUACACUUUUACUGA (SEQ ID NO:4827)), AD-961334 (CAACACAATUTCUUCUUAGCA (SEQ ID NO: 5026)), or AD-1251325 (AAAACAAUCUUCCGUUUCAAA (SEQ ID NO: 4822)). In some embodiments, the portion is a portion of a corresponding chemically modified sequence provided in Tables 5A, 13A, 14A, 15A, and 16.

In some embodiments, the portion of the sense strand is a sense strand chosen from the sense strands of AD-1251284 (UGUCGAGUACACUUUUACUGA (SEQ ID NO:4827)), AD-961334 (CAACACAATUTCUUCUUAGCA (SEQ ID NO: 5026)), or AD-1251325 (AAAACAAUCUUCCGUUUCAAA (SEQ ID NO: 4822)). In some embodiments, the portion is a portion of a corresponding chemically modified sequence provided in Tables 5A, 13A, 14A, 15A, and 16.

In some embodiments, the portion of the antisense strand is a portion within an antisense strand from a duplex chosen from AD-1251284 (UCAGTAAAAGUGUACTCGACAUU (SEQ ID NO: 5093)), AD-961334 (UGCUAAGAAGAAATUGUGUUGUU (SEQ ID NO: 5292)), or AD-1251325 (UUUGAAACGGAAGAUUGUUUUCC (SEQ ID NO: 5088)). In some embodiments, the portion is a portion of a corresponding chemically modified sequence provided in Tables 5A, 13A, 14A, 15A, and 16.

In some embodiments, the portion of the antisense strand is an antisense strand chosen from the antisense strands of AD-1251284 (UCAGTAAAAGUGUACTCGACAUU (SEQ ID NO: 5093)), AD-961334 (UGCUAAGAAGAAATUGUGUUGUU (SEQ ID NO: 5292)), or AD-1251325 (UUUGAAACGGAAGAUUGUUUUCC (SEQ ID NO: 5088)). In some embodiments, the portion is a portion of a corresponding chemically modified sequence provided in Tables 5A, 13A, 14A, 15A, and 16.

In some embodiments, the sense strand and the antisense strand of the dsRNA agent comprise nucleotide sequences of the paired sense strand and antisense strand of a duplex selected from AD-1251284 (SEQ ID NO: 4827 and 5093), AD-961334 (SEQ ID NO: 5026 and 5292), or AD-1251325 (SEQ ID NO: 4822 and 5088). In some embodiments, the sense strand and antisense strand comprises the corresponding chemically modified sense sequence and antisense sequence provided in Tables 5A, 13A, 14A, 15A, and 16.

In some embodiments, at least one of the sense strand and the antisense strand is conjugated to one or more lipophilic moieties. In some embodiments, the lipophilic moiety is conjugated to one or more positions in the double stranded region of the dsRNA agent. In some embodiments, the lipophilic moiety is conjugated via a linker or carrier. In some embodiments, lipophilicity of the lipophilic moiety, measured by log Kow, exceeds 0. In some embodiments, In some embodiments, the hydrophobicity of the double-stranded RNAi agent, measured by the unbound fraction in a plasma protein binding assay of the double-stranded RNAi agent, exceeds 0.2. In some embodiments, the plasma protein binding assay is an electrophoretic mobility shift assay using human serum albumin protein.

In some embodiments, the dsRNA agent comprises at least one modified nucleotide. In some embodiments, no more than five of the sense strand nucleotides and not more than five of the nucleotides of the antisense strand are unmodified nucleotides. In some embodiments, all of the nucleotides of the sense strand and all of the nucleotides of the antisense strand comprise a modification.

In some embodiments, at least one of the modified nucleotides is selected from the group consisting of a deoxynucleotide, a 3'-terminal deoxythimidine (dT) nucleotide, a 2'-O-methyl modified nucleotide, a 2'-fluoro modified nucleotide, a 2'-deoxy-modified nucleotide, a locked nucleotide, an unlocked nucleotide, a conformationally restricted nucleotide, a constrained ethyl nucleotide, an abasic nucleotide, a 2'-amino-modified nucleotide, a 2'-O-allyl-modified nucleotide, 2'-C-alkyl-modified nucleotide, a 2'-methoxyethyl modified nucleotide, a 2'-O-alkyl-modified nucleotide, a morpholino nucleotide, a phosphoramidate, a non-natural base comprising nucleotide, a tetrahydropyran modified nucleotide, a 1,5-anhydrohexitol modified nucleotide, a cyclohexenyl modified nucleotide, a nucleotide comprising a phosphorothioate group, a nucleotide comprising a methylphosphonate group, a nucleotide comprising a 5'-phosphate, a nucleotide comprising a 5'-phosphate mimic, a glycol modified nucleotide, and a 2-O—(N-methylacetamide) modified nucleotide; and combinations thereof. In some embodiments, no more than five of the sense strand nucleotides and not more than five of the nucleotides of the antisense strand include modifications other than 2'-O-methyl modified nucleotide, a 2'-fluoro modified nucleotide, a 2'-deoxy-modified nucleotide, unlocked nucleic acids (UNA) or glycerol nucleic acid (GNA).

In some embodiments, the dsRNA comprises a non-nucleotide spacer (wherein optionally the non-nucleotide spacer comprises a C3-C6 alkyl) between two of the contiguous nucleotides of the sense strand or between two of the contiguous nucleotides of the antisense strand.

In some embodiments, each strand is no more than 30 nucleotides in length. In some embodiments, at least one strand comprises a 3' overhang of at least 1 nucleotide. In some embodiments, at least one strand comprises a 3' overhang of at least 2 nucleotides. In some embodiments, at least one strand comprises a 3' overhang of 2 nucleotides.

In some embodiments, the double stranded region is 15-30 nucleotide pairs in length. In some embodiments, the double stranded region is 17-23 nucleotide pairs in length. In some embodiments, the double stranded region is 17-25 nucleotide pairs in length. In some embodiments, the double stranded region is 23-27 nucleotide pairs in length. In some embodiments, the double stranded region is 19-21 nucleotide pairs in length. In some embodiments, the double stranded region is 21-23 nucleotide pairs in length. In some embodiments, each strand has 19-30 nucleotides. In some embodiments, each strand has 19-23 nucleotides. In some embodiments, each strand has 21-23 nucleotides.

In some embodiments, the agent comprises at least one phosphorothioate or methylphosphonate internucleotide linkage. In some embodiments, the phosphorothioate or methylphosphonate internucleotide linkage is at the 3'-terminus of one strand. In some embodiments, the strand is the antisense strand. In some embodiments, the strand is the sense strand.

In some embodiments, the phosphorothioate or methylphosphonate internucleotide linkage is at the 5'-terminus of one strand. In some embodiments, the strand is the antisense strand. In some embodiments, the strand is the sense strand.

In some embodiments, each of the 5'- and 3'-terminus of one strand comprises a phosphorothioate or methylphosphonate internucleotide linkage. In some embodiments, the strand is the antisense strand.

In some embodiments, the base pair at the 1 position of the 5'-end of the antisense strand of the duplex is an AU base pair.

In some embodiments, the sense strand has a total of 21 nucleotides and the antisense strand has a total of 23 nucleotides.

In some embodiments, one or more lipophilic moieties are conjugated to one or more internal positions on at least one strand. In some embodiments, the one or more lipophilic moieties are conjugated to one or more internal positions on at least one strand via a linker or carrier.

In some embodiments, the internal positions include all positions except the terminal two positions from each end of the at least one strand. In some embodiments, the internal positions include all positions except the terminal three positions from each end of the at least one strand. In some embodiments, the internal positions exclude a cleavage site region of the sense strand. In some embodiments, the internal positions include all positions except positions 9-12, counting from the 5'-end of the sense strand. In some embodiments, the internal positions include all positions except positions 11-13, counting from the 3'-end of the sense strand. In some embodiments, the internal positions exclude a cleavage site region of the antisense strand. In some embodiments, the internal positions include all positions except positions 12-14, counting from the 5'-end of the antisense strand. In some embodiments, the internal positions include all positions except positions 11-13 on the sense strand, counting from the 3'-end, and positions 12-14 on the antisense strand, counting from the 5'-end.

In some embodiments, the one or more lipophilic moieties are conjugated to one or more of the internal positions selected from the group consisting of positions 4-8 and 13-18 on the sense strand, and positions 6-10 and 15-18 on the antisense strand, counting from the 5'end of each strand. In some embodiments, the one or more lipophilic moieties are conjugated to one or more of the internal positions selected from the group consisting of positions 5, 6, 7, 15, and 17 on the sense strand, and positions 15 and 17 on the antisense strand, counting from the 5'-end of each strand.

In some embodiments, the positions in the double stranded region exclude a cleavage site region of the sense strand.

In some embodiments, the sense strand is 21 nucleotides in length, the antisense strand is 23 nucleotides in length, and the lipophilic moiety is conjugated to position 21, position 20, position 15, position 1, position 7, position 6, or position 2 of the sense strand or position 16 of the antisense strand. In some embodiments, the lipophilic moiety is conjugated to position 21, position 20, position 15, position 1, or position 7 of the sense strand. In some embodiments, the lipophilic moiety is conjugated to position 21, position 20, or position 15 of the sense strand. In some embodiments, the lipophilic moiety is conjugated to position 20 or position 15 of the sense strand. In some embodiments, the lipophilic moiety is conjugated to position 16 of the antisense strand. In some embodiments, the lipophilic moiety is conjugated to position 6, counting from the 5'-end of the sense strand.

In some embodiments, the lipophilic moiety is an aliphatic, alicyclic, or polyalicyclic compound. In some embodiments, the lipophilic moiety is selected from the group consisting of lipid, cholesterol, retinoic acid, cholic acid, adamantane acetic acid, 1-pyrene butyric acid, dihydrotestosterone, 1,3-bis-O(hexadecyl)glycerol, geranyloxyhexyanol, hexadecylglycerol, borneol, menthol, 1,3-propanediol, heptadecyl group, palmitic acid, myristic acid, O3-(oleoyl)lithocholic acid, O3-(oleoyl)cholenic acid, dimethoxytrityl, or phenoxazine. In some embodiments, the lipophilic moiety contains a saturated or unsaturated C4-C30 hydrocarbon chain, and an optional functional group selected from the group consisting of hydroxyl, amine, carboxylic acid, sulfonate, phosphate, thiol, azide, and alkyne. In some embodiments, the lipophilic moiety contains a saturated or unsaturated C6-C18 hydrocarbon chain. In some embodiments, the lipophilic moiety contains a saturated or unsaturated C16 hydrocarbon chain.

In some embodiments, the lipophilic moiety is conjugated via a carrier that replaces one or more nucleotide(s) in the internal position(s) or the double stranded region. In some embodiments, the carrier is a cyclic group selected from the group consisting of pyrrolidinyl, pyrazolinyl, pyrazolidinyl, imidazolinyl, imidazolidinyl, piperidinyl, piperazinyl, [1,3] dioxolanyl, oxazolidinyl, isoxazolidinyl, morpholinyl, thiazolidinyl, isothiazolidinyl, quinoxalinyl, pyridazinonyl, tetrahydrofuranyl, and decalinyl; or is an acyclic moiety based on a serinol backbone or a diethanolamine backbone.

In some embodiments, the lipophilic moiety is conjugated to the double-stranded iRNA agent via a linker containing an ether, thioether, urea, carbonate, amine, amide, maleimide-thioether, disulfide, phosphodiester, sulfonamide linkage, a product of a click reaction, or carbamate.

In some embodiments, the lipophilic moiety is conjugated to a nucleobase, sugar moiety, or internucleosidic linkage.

In some embodiments, the lipophilic moiety or targeting ligand is conjugated via a bio-cleavable linker selected from the group consisting of DNA, RNA, disulfide, amide, functionalized monosaccharides or oligosaccharides of galactosamine, glucosamine, glucose, galactose, mannose, and combinations thereof.

In some embodiments, the 3' end of the sense strand is protected via an end cap which is a cyclic group having an amine, said cyclic group being selected from the group consisting of pyrrolidinyl, pyrazolinyl, pyrazolidinyl, imidazolinyl, imidazolidinyl, piperidinyl, piperazinyl, [1,3]dioxolanyl, oxazolidinyl, isoxazolidinyl, morpholinyl, thiazolidinyl, isothiazolidinyl, quinoxalinyl, pyridazinonyl, tetrahydrofuranyl, and decalinyl.

In some embodiments, the dsRNA agent further comprises a targeting ligand, e.g., a ligand that targets a CNS tissue or a liver tissue. In some embodiments, the CNS tissue is a brain tissue or a spinal tissue, e.g., a dorsal root ganglion.

In some embodiments, the ligand is conjugated to the sense strand. In some embodiments, the ligand is conjugated to the 3' end or the 5' end of the sense strand. In some embodiments, the ligand is conjugated to the 3' end of the sense strand.

In some embodiments, the ligand comprises N-acetylgalactosamine (GalNAc). In some embodiments, the targeting ligand comprises one or more GalNAc conjugates or one or more GalNAc derivatives. In some embodiments, the ligand is one or more GalNAc conjugates or one or more GalNAc derivatives are attached through a monovalent linker, or a bivalent, trivalent, or tetravalent branched linker. In some embodiments, the ligand is

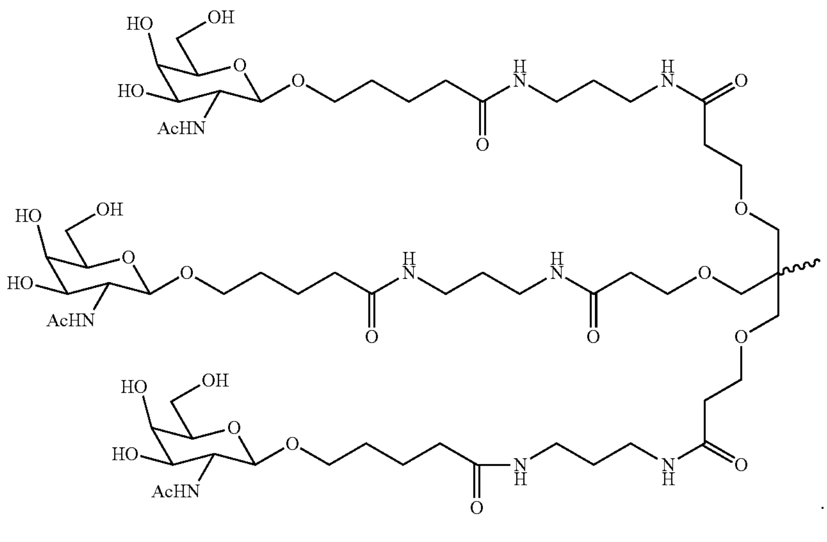 [SMILES: CC(=O)NC1C(OCCCCC(=O)NCCCNC(=O)CCOCC(C)(COCCC(=O)NCCCNC(=O)CCCCOC2OC(CO)C(O)C(O)C2NC(C)=O)COCCC(=O)NCCCNC(=O)CCCCOC2OC(CO)C(O)C(O)C2NC(C)=O)OC(CO)C(O)C1O]

.

In some embodiments, the dsRNA agent is conjugated to the ligand as shown in the following schematic

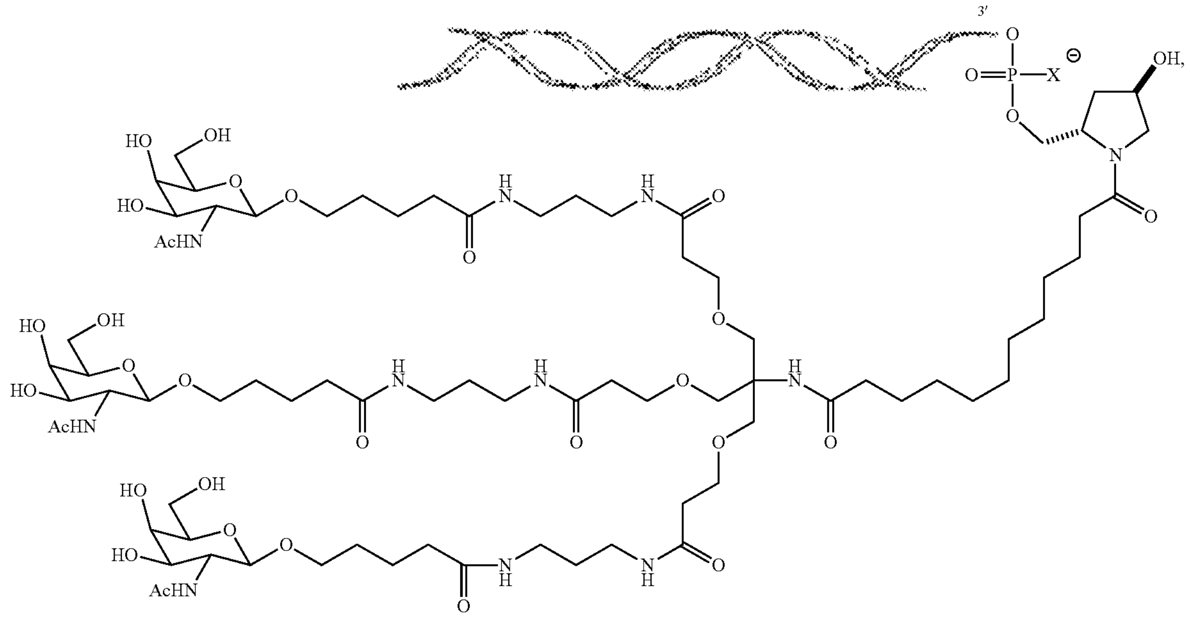

wherein X is O or S. In some embodiments, the X is O.

In some embodiments, the dsRNA agent further comprises a terminal, chiral modification occurring at the first internucleotide linkage at the 3' end of the antisense strand, having the linkage phosphorus atom in Sp configuration, a terminal, chiral modification occurring at the first internucleotide linkage at the 5' end of the antisense strand, having the linkage phosphorus atom in Rp configuration, and a terminal, chiral modification occurring at the first internucleotide linkage at the 5' end of the sense strand, having the linkage phosphorus atom in either Rp configuration or Sp configuration.

In some embodiments, the dsRNA agent further comprises a terminal, chiral modification occurring at the first and second internucleotide linkages at the 3' end of the antisense strand, having the linkage phosphorus atom in Sp configuration, a terminal, chiral modification occurring at the first internucleotide linkage at the 5' end of the antisense strand, having the linkage phosphorus atom in Rp configuration, and a terminal, chiral modification occurring at the first internucleotide linkage at the 5' end of the sense strand, having the linkage phosphorus atom in either Rp or Sp configuration.

In some embodiments, the dsRNA agent further comprises a terminal, chiral modification occurring at the first, second and third internucleotide linkages at the 3' end of the antisense strand, having the linkage phosphorus atom in Sp configuration, a terminal, chiral modification occurring at the first internucleotide linkage at the 5' end of the antisense strand, having the linkage phosphorus atom in Rp configuration, and a terminal, chiral modification occurring at the first internucleotide linkage at the 5' end of the sense strand, having the linkage phosphorus atom in either Rp or Sp configuration.

In some embodiments, the dsRNA agent further comprises a terminal, chiral modification occurring at the first, and second internucleotide linkages at the 3' end of the antisense strand, having the linkage phosphorus atom in Sp configuration, a terminal, chiral modification occurring at the third internucleotide linkages at the 3' end of the antisense strand, having the linkage phosphorus atom in Rp configuration, a terminal, chiral modification occurring at the first internucleotide linkage at the 5' end of the antisense strand, having the linkage phosphorus atom in Rp configuration, and a terminal, chiral modification occurring at the first internucleotide linkage at the 5' end of the sense strand, having the linkage phosphorus atom in either Rp or Sp configuration.

In some embodiments, the dsRNA agent further comprises a terminal, chiral modification occurring at the first, and second internucleotide linkages at the 3' end of the antisense strand, having the linkage phosphorus atom in Sp configuration, a terminal, chiral modification occurring at the first, and second internucleotide linkages at the 5' end of the antisense strand, having the linkage phosphorus atom in Rp configuration, and a terminal, chiral modification occurring at the first internucleotide linkage at the 5' end of the sense strand, having the linkage phosphorus atom in either Rp or Sp configuration.

In some embodiments, the dsRNA agent further comprises a phosphate or phosphate mimic at the 5'-end of the antisense strand. In some embodiments, the phosphate mimic is a 5'-vinyl phosphonate (VP).

In some embodiments, a cell described herein, e.g., a human cell, was produced by a process comprising contacting a human cell with the dsRNA agent described herein.

In some embodiments, a pharmaceutical composition described herein comprises the dsRNA agent and a lipid formulation.

In some embodiments (e.g., embodiments of the methods described herein), the cell is within a subject. In some embodiments, the subject is a human. In some embodiments, the level of SCN9A mRNA is inhibited by at least 50%. In some embodiments, the level of SCN9A protein is inhibited by at least 50%. In some embodiments, the expression of SCN9A is inhibited by at least 50%. In some embodiments, inhibiting expression of SCN9A decreases the SCN9A protein level in a biological sample (e.g., a cerebral spinal fluid (CSF) sample, or a CNS biopsy sample) from the subject by at least 30%, 40%, 50%, 60%, 70%, 80%, 90%, or 95%. In some embodiments, inhibiting expression of SCN9A gene decreases the SCN9A mRNA level in a biological sample (e.g., a cerebral spinal fluid (CSF) sample, or a CNS biopsy sample) from the subject by at least 30%, 40%, 50%, 60%, 70%, 80%, 90%, or 95%.

In some embodiments, the subject has or has been diagnosed with having a SCN9A-associated disorder. In some embodiments, the subject meets at least one diagnostic criterion for a SCN9A-associated disorder. In some embodiments, the SCN9A associated disorder is pain, e.g., chronic pain e.g., inflammatory pain, neuropathic pain, pain hypersensitivity, pain hyposensitivity, inability to sense pain, primary erythromelalgia (PE), paroxysmal extreme pain disorder (PEPD), small fiber neuropathy (SFN), trigeminal neuralgia (TN), and pain associated with, e.g., cancer, arthritis, diabetes, traumatic injury and viral infections.

In some embodiments, the neuronal cell or tissue is a peripheral sensory neuron, e.g., a peripheral sensory neuron in a dorsal root ganglion, or a nociceptive neuron, e.g., an A-delta fiber or a C-type fiber.

In some embodiments, the SCN9A-associated disorder is pain, e.g., chronic pain. In some embodiments, the chronic pain is caused by or associated with pain hypersensitivity, pain hyposensitivity, inability to sense pain, primary erythromelalgia (PE), paroxysmal extreme pain disorder (PEPD), small fiber neuropathy (SFN), trigeminal neuralgia (TN), and pain associated with, e.g., cancer, arthritis, diabetes, traumatic injury or viral infections In some embodiments, treating comprises amelioration of at least one sign or symptom of the disorder. In some embodiments, the at least one sign or symptom includes a measure of one or more of pain sensitivity, pain threshold, pain level, pain disability level presence, level, or activity of SCN9A (e.g., SCN9A gene, SCN9A mRNA, or SCN9A protein).

In some embodiments, a level of the SCN9A that is higher than a reference level is indicative that the subject has pain, e.g., chronic pain or a pain-related disorder. In some embodiments, treating comprises prevention of progression of the disorder. In some embodiments, the treating comprises one or more of (a) reducing pain; or (b) inhibiting or reducing the expression or activity of SCN9A.

In some embodiments, the treating results in at least a 30% mean reduction from baseline of SCN9A mRNA in the dorsal root ganglion. In some embodiments, the treating results in at least a 60% mean reduction from baseline of SCN9A mRNA in the dorsal root ganglion. In some embodiments, the treating results in at least a 90% mean reduction from baseline of SCN9A mRNA in the dorsal root ganglion.

In some embodiments, after treatment the subject experiences at least an 8-week duration of knockdown following a single dose of dsRNA as assessed by SCN9A protein in the cerebral spinal fluid (CSF) or the CNS tissue, e.g., the dorsal root ganglion. In some embodiments, treating results in at least a 12-week duration of knockdown following a single dose of dsRNA as assessed by SCN9A protein in the cerebral spinal fluid (CSF) or the CNS tissue, e.g., the dorsal root ganglion. In some embodiments, treating results in at least a 16-week duration of knockdown following a single dose of dsRNA as assessed by SCN9A protein in the cerebral spinal fluid (CSF) or the CNS tissue, e.g., the dorsal root ganglion.

In some embodiments, the subject is human.

In some embodiments, the dsRNA agent is administered at a dose of about 0.01 mg/kg to about 50 mg/kg.

In some embodiments, the dsRNA agent is administered to the subject intracranially or intrathecally.

In some embodiments, the dsRNA agent is administered to the subject intrathecally, intraventricularly, or intracerebrally.

In some embodiments, a method described herein further comprises measuring a level of SCN9A (e.g., SCN9A gene, SCN9A mRNA, or SCN9A protein) in the subject. In some embodiments, measuring the level of SCN9A in the subject comprises measuring the level of SCN9A protein in a biological sample from the subject (e.g., a cerebral spinal fluid (CSF) sample or a CNS biopsy sample). In some embodiments, a method described herein further comprises performing a blood test, an imaging test, or, a CNS biopsy, or an aqueous cerebral spinal fluid biopsy.

In some embodiments, a method described herein further measuring level of SCN9A (e.g., SCN9A gene, SCN9A mRNA, or SCN9A protein) in the subject is performed prior to treatment with the dsRNA agent or the pharmaceutical composition. In some embodiments, upon determination that a subject has a level of SCN9A that is greater than a reference level, the dsRNA agent or the pharmaceutical composition is administered to the subject. In some embodiments, measuring level of SCN9A in the subject is performed after treatment with the dsRNA agent or the pharmaceutical composition.

In some embodiments, a method described herein further comprises treating the subject with a therapy suitable for treatment or prevention of a SCN9A-associated disorder, e.g., wherein the therapy comprises non-steroidal anti-inflammatory drugs (NSAIDs), acetaminophen, opioids, or corticosteroids, acupuncture, therapeutic massage, dorsal root ganglion stimulation, spinal cord stimulation, or topical pain relievers. In some embodiments, a method described herein further comprises administering to the subject an additional agent suitable for treatment or prevention of a SCN9A-associated disorder. In some embodiments, the additional agent comprises a steroid, or a non-steroidal anti-inflammatory agent.

All publications, patent applications, patents, and other references mentioned herein are incorporated by reference in their entirety.

The details of various embodiments of the disclosure are set forth in the description below. Other features, objects, and advantages of the disclosure will be apparent from the description and the drawings, and from the claims.

BRIEF DESCRIPTION OF THE DRAWINGS

FIGS. 1A-1C disclose SEQ ID NOS 5996-6029, respectively, in order of appearance.

FIGS. 3A-3B disclose SEQ ID NOS 6030-6051, respectively, in order of appearance. FIGS. 3C-3D disclose SEQ ID NOS 6052-6071, respectively, in order of appearance.

FIG. 4A depicts the percent SCN9A message remaining with the duplexes tested at a final concentration of 0.1 nM. FIG. 4B depicts the percent SCN9A message remaining with the duplexes tested at a final concentration of 1 nM. FIG. 4C depicts the percent SCN9A message remaining with the duplexes tested at a final concentration of 10 nM. In FIGS. 4A-4C, screen 1 includes the following duplexes: AD-1010663.3, AD-1251301.1, AD-1251249.1, AD-1251251.1, AD-795305.3, AD-1251363.1, AD-1251364.1, AD-1251373.1, AD-795634.4, AD-1251385.1, AD-1251391.1, AD-1251317.1, AD-1251318.1, AD-1251323.1, AD-1251325.1, and AD-961179.3; screen 2 included the following duplexes: AD-1251492.1, AD-1251279.1, AD-961334.3, AD-1251284.1, AD-1251334.1, AD-1251377.1, AD-1251398.1, AD-1251399.1, AD-1251274.2, AD-961188.3, AD-1251411.1, AD-1251419.1, AD-796825.3, AD-1251428.1, AD-797564.4, and AD-1251434.1.

FIG. 6A discloses SEQ ID NOS 6072-6077, respectively, in order of appearance. FIG. 6B discloses SEQ ID NOS 6078-6083, respectively, in order of appearance.

Figure 1A:
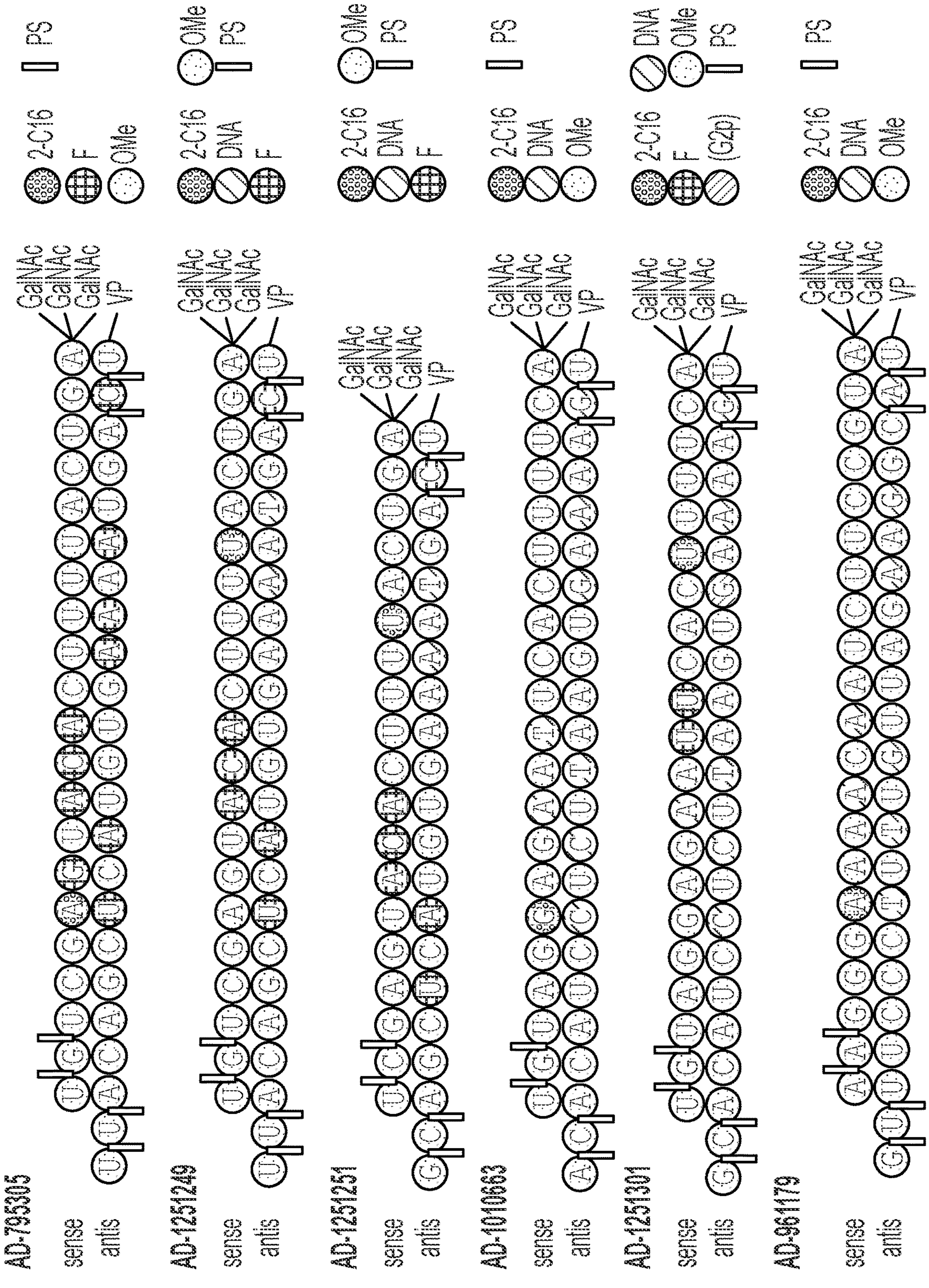
FIG. 1A depicts the sequences and chemistry of exemplary SCN9A siRNAs including AD-795305, AD-1251249, AD-1251251, AD-1010663, AD-1251301, and AD-961179.

DETAILED DESCRIPTION iRNA directs the sequence-specific degradation of mRNA through a process known as RNA interference (RNAi). Described herein are iRNAs and methods of using them for modulating (e.g., inhibiting) the expression of SCN9A. Also provided are compositions and methods for treatment of disorders related to SCN9A expression, such as pain, e.g., acute pain or chronic pain (e.g., inflammatory (nociceptive), neuropathic pain, pain hypersensitivity, pain hyposensitivity, inability to sense pain, primary erythromelalgia (PE), paroxysmal extreme pain disorder (PEPD), small fiber neuropathy (SFN), trigeminal neuralgia (TN), and pain associated with, e.g., cancer, arthritis, diabetes, traumatic injury and viral infections).

Human SCN9A is approximately a 226 kDa protein and is a voltage gated sodium channel (Nav1.7 channel) that mediates the voltage-dependent sodium ion permeability of excitable membranes and also plays a role in nociception signaling. These channels are preferentially expressed in peripheral sensory neurons of the dorsal root ganglia, which are involved in the perception of pain. Mutations in the SCN9A gene have been associated with predispositions to pain hyper- or hyposensitivity. For example, gain-of-function mutations in the SCN9A gene can be the etiological basis of inherited pain syndromes such as primary erythermalgia (PE) and paroxysmal extreme pain disorder (PEPD). Moreover, loss-of-function mutations of the SCN9A gene result in a complete inability of an otherwise healthy individual to sense any form of pain. Without wishing to be bound by theory, increased levels of the SCN9A expression could enhance pain sensitivity; whereas decreased levels of the SCN9A expression could reduce pain sensitivity, and modulating SCN9A expression and Nav1.7 channel levels in peripheral sensory neurons of the dorsal root ganglia could provide an effective pain treatment.

The following description discloses how to make and use compositions containing iRNAs to modulate (e.g., inhibit) the expression of SCN9A, as well as compositions and methods for treating disorders related to expression of SCN9A.

In some aspects, pharmaceutical compositions containing SCN9A iRNA and a pharmaceutically acceptable carrier, methods of using the compositions to inhibit expression of SCN9A, and methods of using the pharmaceutical compositions to treat disorders related to expression of SCN9A (e.g., pain, e.g., chronic pain and/or pain related disorders) are featured herein.

I. Definitions

For convenience, the meaning of certain terms and phrases used in the specification, examples, and appended claims, are provided below. If there is an apparent discrepancy between the usage of a term in other parts of this specification and its definition provided in this section, the definition in this section shall prevail.

The term "about" when referring to a number or a numerical range means that the number or numerical range referred to is an approximation within experimental variability (or within statistical experimental error), and thus the number or numerical range may vary from, for example, between 1% and 15% of the stated number or numerical range.

The terms "or more" and "at least" prior to a number or series of numbers is understood to include the number adjacent to the term "at least", and all subsequent numbers or integers that could logically be included, as clear from context. For example, the number of nucleotides in a nucleic acid molecule must be an integer. For example, "at least 17 nucleotides of a 20-nucleotide nucleic acid molecule" means that 17, 18, 19, or 20 nucleotides have the indicated property. When "at least" is present before a series of numbers or a range, it is understood that "at least" can modify each of the numbers in the series or range.

As used herein, "or less" and "no more than" are understood as including the value adjacent to the phrase and logical lower values or integers, as logical from context, to zero. For example, a duplex with mismatches to a target site of "no more than 2 nucleotides" has a 2, 1, or 0 mismatches. When "no more than" is present before a series of numbers or a range, it is understood that "no more than" can modify each of the numbers in the series or range.

As used herein, "less than" is understood as not including the value adjacent to the phrase and including logical lower values or integers, as logical from context, to zero. For example, a duplex with mismatches to a target site of "less than 3 nucleotides" has 2, 1, or 0 mismatches. When "less than" is present before a series of numbers or a range, it is understood that "less than" can modify each of the numbers in the series or range.

As used herein, "more than" is understood as not including the value adjacent to the phrase and including logical higher values or integers, as logical from context, to infinity. For example, a duplex with mismatches to a target site of "more than 3 nucleotides" has 4, 5, 6, or more mismatches. When "more than" is present before a series of numbers or a range, it is understood that "more than" can modify each of the numbers in the series or range.

As used herein, "up to" as in "up to 10" is understood as up to and including 10, i.e., 0, 1, 2, 3, 4, 5, 6, 7, 8, 9, or 10.

Ranges provided herein are understood to include all individual integer values and all subranges within the ranges.

The terms "activate," "enhance," "up-regulate the expression of," "increase the expression of," and the like, in so far as they refer to a SCN9A gene, herein refer to the at least partial activation of the expression of a SCN9A gene, as manifested by an increase in the amount of SCN9A mRNA, which may be isolated from or detected in a first cell or group of cells in which a SCN9A gene is transcribed and which has or have been treated such that the expression of a SCN9A gene is increased, as compared to a second cell or group of cells substantially identical to the first cell or group of cells but which has or have not been so treated (control cells).

In some embodiments, expression of a SCN9A gene is activated by at least about 10%, 15%, 20%, 25%, 30%, 35%, 40%, 45%, or 50% by administration of an iRNA as described herein. In some embodiments, a SCN9A gene is activated by at least about 60%, 70%, or 80% by administration of an iRNA featured in the disclosure. In some embodiments, expression of a SCN9A gene is activated by at least about 85%, 90%, or 95% or more by administration of an iRNA as described herein. In some embodiments, the SCN9A gene expression is increased by at least 1-fold, at least 2-fold, at least 5-fold, at least 10-fold, at least 50-fold, at least 100-fold, at least 500-fold, at least 1000-fold or more in cells treated with an iRNA as described herein compared to the expression in an untreated cell. Activation of expression by small dsRNAs is described, for example, in Li et al., 2006 Proc. Natl. Acad. Sci. U.S.A. 103:17337-42, and in US2007/0111963 and US2005/226848, each of which is incorporated herein by reference.

The terms "silence," "inhibit expression of," "down-regulate expression of," "suppress expression of," and the like, in so far as they refer to SCN9A, herein refer to the at least partial suppression of the expression of SCN9A, as assessed, e.g., based on SCN9A mRNA expression, SCN9A protein expression, or another parameter functionally linked to SCN9A expression. For example, inhibition of SCN9A expression may be manifested by a reduction of the amount of SCN9A mRNA which may be isolated from or detected in a first cell or group of cells in which SCN9A is transcribed and which has or have been treated such that the expression of SCN9A is inhibited, as compared to a control. The control may be a second cell or group of cells substantially identical to the first cell or group of cells, except that the second cell or group of cells have not been so treated (control cells). The degree of inhibition is usually expressed as a percentage of a control level, e.g., $$\frac{(mRNA \text{ in control cells}) - (mRNA \text{ in treated cells})}{(mRNA \text{ in control cells})} \cdot 100\%$$

Alternatively, the degree of inhibition may be given in terms of a reduction of a parameter that is functionally linked to SCN9A expression, e.g., the amount of protein encoded by a SCN9A gene. The reduction of a parameter functionally linked to SCN9A expression may similarly be expressed as a percentage of a control level. In principle, SCN9A silencing may be determined in any cell expressing SCN9A, either constitutively or by genomic engineering, and by any appropriate assay.

For example, in certain instances, expression of SCN9A is suppressed by at least about 10%, 15%, 20%, 25%, 30%, 35%, 40%, 45%, or 50% by administration of an iRNA disclosed herein. In some embodiments, SCN9A is suppressed by at least about 60%, 65%, 70%, 75%, or 80% by administration of an iRNA disclosed herein. In some embodiments, SCN9A is suppressed by at least about 85%, 90%, 95%, 98%, 99%, or more by administration of an iRNA as described herein.

The term "antisense strand" or "guide strand" refers to the strand of an iRNA, e.g., a dsRNA, which includes a region that is substantially complementary to a target sequence.

As used herein, the term "region of complementarity" refers to the region on the antisense strand that is substantially complementary to a sequence, for example a target sequence, as defined herein. Where the region of complementarity is not fully complementary to the target sequence, the mismatches may be in the internal or terminal regions of the molecule. In some embodiments, the region of complementarity comprises 0, 1, or 2 mismatches.

The term "sense strand" or "passenger strand" as used herein, refers to the strand of an iRNA that includes a region that is substantially complementary to a region of the antisense strand as that term is defined herein.

The terms "blunt" or "blunt ended" as used herein in reference to a dsRNA mean that there are no unpaired nucleotides or nucleotide analogs at a given terminal end of a dsRNA, i.e., no nucleotide overhang. One or both ends of a dsRNA can be blunt. Where both ends of a dsRNA are blunt, the dsRNA is said to be blunt ended. To be clear, a "blunt ended" dsRNA is a dsRNA that is blunt at both ends, i.e., no nucleotide overhang at either end of the molecule. Most often such a molecule will be double-stranded over its entire length.

As used herein, and unless otherwise indicated, the term "complementary," when used to describe a first nucleotide sequence in relation to a second nucleotide sequence, refers to the ability of an oligonucleotide or polynucleotide comprising the first nucleotide sequence to hybridize and form a duplex structure under certain conditions with an oligonucleotide or polynucleotide comprising the second nucleotide sequence, as will be understood by the skilled person. Such conditions can be, for example, "stringent conditions", where stringent conditions may include: 400 mM NaCl, 40 mM PIPES pH 6.4, 1 mM EDTA, 50° C. or 70° C. for 12-16 hours followed by washing. Other conditions, such as physiologically relevant conditions as may be encountered inside an organism, can apply. The skilled person will be able to determine the set of conditions most appropriate for a test of complementarity of two sequences in accordance with the ultimate application of the hybridized nucleotides.

Complementary sequences within an iRNA, e.g., within a dsRNA as described herein, include base-pairing of the oligonucleotide or polynucleotide comprising a first nucleotide sequence to an oligonucleotide or polynucleotide comprising a second nucleotide sequence over the entire length of one or both nucleotide sequences. Such sequences can be referred to as "fully complementary" with respect to each other herein. However, where a first sequence is referred to as "substantially complementary" with respect to a second sequence herein, the two sequences can be fully complementary, or they may form one or more, but generally not more than 5, 4, 3 or 2 mismatched base pairs upon hybridization for a duplex up to 30 base pairs, while retaining the ability to hybridize under the conditions most relevant to their ultimate application, e.g., inhibition of gene expression via a RISC pathway. However, where two oligonucleotides are designed to form, upon hybridization, one or more single stranded overhangs, such overhangs shall not be regarded as mismatches with regard to the determination of complementarity. For example, a dsRNA comprising one oligonucleotide 21 nucleotides in length and another oligonucleotide 23 nucleotides in length, wherein the longer oligonucleotide comprises a sequence of 21 nucleotides that is fully complementary to the shorter oligonucleotide, may yet be referred to as "fully complementary" for the purposes described herein.

Complementary sequences, as used herein, may also include, or be formed entirely from, non-Watson-Crick base pairs and/or base pairs formed from non-natural and modified nucleotides, in as far as the above requirements with respect to their ability to hybridize are fulfilled. Such non-Watson-Crick base pairs includes, but are not limited to, G:U Wobble or Hoogsteen base pairing.

The terms "complementary," "fully complementary" and "substantially complementary" herein may be used with respect to the base matching between two oligonucleotides or polynucleotides, such as the sense strand and the antisense strand of a dsRNA, or between the antisense strand of an iRNA agent and a target sequence, as will be understood from the context of their use.

As used herein, a polynucleotide that is "substantially complementary to at least part of" a messenger RNA (mRNA) refers to a polynucleotide that is substantially complementary to a contiguous portion of the mRNA of interest (e.g., an mRNA encoding a SCN9A protein). For example, a polynucleotide is complementary to at least a part of a SCN9A mRNA if the sequence is substantially complementary to a non-interrupted portion of an mRNA encoding SCN9A. The term "complementarity" refers to the capacity for pairing between nucleobases of a first nucleic acid and a second nucleic acid.

As used herein, the term "region of complementarity" refers to the region of one nucleotide sequence agent that is substantially complementary to another sequence, e.g., the region of a sense sequence and corresponding antisense sequence of a dsRNA, or the antisense strand of an iRNA and a target sequence, e.g., a SCN9A nucleotide sequence, as defined herein. Where the region of complementarity is not fully complementary to the target sequence, the mismatches can be in the internal or terminal regions of the antisense strand of the iRNA. Generally, the most tolerated mismatches are in the terminal regions, e.g., within 5, 4, 3, or 2 nucleotides of the 5'- or 3'-terminus of the iRNA agent.

"Contacting," as used herein, includes directly contacting a cell, as well as indirectly contacting a cell. For example, a cell within a subject may be contacted when a composition comprising an iRNA is administered (e.g., intrathecally, intracranially, intracerebrally, or intraventricularly) to the subject.

"Introducing into a cell," when referring to an iRNA, means facilitating or effecting uptake or absorption into the cell. Absorption or uptake of an iRNA can occur through unaided diffusive or active cellular processes, or by auxiliary agents or devices. The meaning of this term is not limited to cells in vitro; an iRNA may also be "introduced into a cell," wherein the cell is part of a living organism. In such an instance, introduction into the cell will include the delivery to the organism. For example, for in vivo delivery, iRNA can be injected into a tissue site or administered systemically. In vivo delivery can also be by a β-glucan delivery system, such as those described in U.S. Pat. Nos. 5,032,401 and 5,607,677, and U.S. Publication No. 2005/0281781, which are hereby incorporated by reference in their entirety. In vitro introduction into a cell includes methods known in the art such as electroporation and lipofection. Further approaches are described herein below or known in the art.

As used herein, a "disorder related to SCN9A expression," a "disease related to SCN9A expression," a "pathological process related to SCN9A expression," "a SCN9A-associated disorder," "a SCN9A-associated disease," or the like includes any condition, disorder, or disease in which SCN9A expression is altered (e.g., decreased or increased relative to a reference level, e.g., a level characteristic of a non-diseased subject). In some embodiments, SCN9A expression is decreased. In some embodiments, SCN9A expression is increased. In some embodiments, the decrease or increase in SCN9A expression is detectable in a tissue sample from the subject (e.g., in a cerebral spinal fluid (CSF) sample or a CNS biopsy sample). The decrease or increase may be assessed relative the level observed in the same individual prior to the development of the disorder or relative to other individual(s) who do not have the disorder. The decrease or increase may be limited to a particular organ, tissue, or region of the body (e.g., the brain or the spine). SCN9A-A-associated disorders include, but are not limited to, pain, e.g., chronic pain or pain-related disorders.

"Pain" as defined herein includes acute pain and chronic pain. Chronic pain includes inflammatory (nociceptive) and neuropathic pain associated with disorders including, but not limited to, cancer, arthritis, diabetes, traumatic injury and viral infections. Also included is pain due to inherited pain syndromes including, but not limited to primary erythermalgia (PE) and paroxysmal extreme pain disorder (PEPD).

The term "double-stranded RNA," "dsRNA," or "siRNA" as used herein, refers to an iRNA that includes an RNA molecule or complex of molecules having a hybridized duplex region that comprises two anti-parallel and substantially complementary nucleic acid strands, which will be referred to as having "sense" and "antisense" orientations with respect to a target RNA. The duplex region can be of any length that permits specific degradation of a desired target RNA, e.g., through a RISC pathway, but will typically range from 9 to 36 base pairs in length, e.g., 15-30 base pairs in length. Considering a duplex between 9 and 36 base pairs, the duplex can be any length in this range, for example, 9, 10, 11, 12, 13, 14, 15, 16, 17, 18, 19, 20, 21, 22, 23, 24, 25, 26, 27, 28, 29, 30, 31, 32, 33, 34, 35, or 36 and any sub-range therein between, including, but not limited to 15-30 base pairs, 15-26 base pairs, 15-23 base pairs, 15-22 base pairs, 15-21 base pairs, 15-20 base pairs, 15-19 base pairs, 15-18 base pairs, 15-17 base pairs, 18-30 base pairs, 18-26 base pairs, 18-23 base pairs, 18-22 base pairs, 18-21 base pairs, 18-20 base pairs, 19-30 base pairs, 19-26 base pairs, 19-23 base pairs, 19-22 base pairs, 19-21 base pairs, 19-20 base pairs, 20-30 base pairs, 20-26 base pairs, 20-25 base pairs, 20-24 base pairs, 20-23 base pairs, 20-22 base pairs, 20-21 base pairs, 21-30 base pairs, 21-26 base pairs, 21-25 base pairs, 21-24 base pairs, 21-23 base pairs, or 21-22 base pairs. dsRNAs generated in the cell by processing with Dicer and similar enzymes are generally in the range of 19-22 base pairs in length. One strand of the duplex region of a dsDNA comprises a sequence that is substantially complementary to a region of a target RNA. The two strands forming the duplex structure can be from a single RNA molecule having at least one self-complementary region, or can be formed from two or more separate RNA molecules. Where the duplex region is formed from two strands of a single molecule, the molecule can have a duplex region separated by a single stranded chain of nucleotides (herein referred to as a "hairpin loop") between the 3'-end of one strand and the 5'-end of the respective other strand forming the duplex structure. The hairpin loop can comprise at least one unpaired nucleotide; in some embodiments the hairpin loop can comprise at least 3, at least 4, at least 5, at least 6, at least 7, at least 8, at least 9, at least 10, at least 20, at least 23 or more unpaired nucleotides. Where the two substantially complementary strands of a dsRNA are comprised by separate RNA molecules, those molecules need not, but can be covalently connected. In some embodiments, the two strands are connected covalently by means other than a hairpin loop, and the connecting structure is a linker.

In some embodiments, the iRNA agent may be a "single-stranded siRNA" that is introduced into a cell or organism to inhibit a target mRNA. In some embodiments, single-stranded RNAi agents can bind to the RISC endonuclease Argonaute 2, which then cleaves the target mRNA. The single-stranded siRNAs are generally 15-30 nucleotides and are optionally chemically modified. The design and testing of single-stranded siRNAs are described in U.S. Pat. No. 8,101,348 and in Lima et al., (2012) Cell 150: 883-894, the entire contents of each of which are hereby incorporated herein by reference. Any of the antisense nucleotide sequences described herein (e.g., sequences provided in Tables 2A, 2B, 4A, 4B, 5A, 5B, 6A, 6B, 13A, 13B, 14A, 14B, 15A, 15B, 16, 18, or 20) may be used as a single-stranded siRNA as described herein and optionally as chemically modified, e.g., as described herein, e.g., by the methods described in Lima et al., (2012) Cell 150:883-894.

In some embodiments, an RNA interference agent includes a single stranded RNA that interacts with a target RNA sequence to direct the cleavage of the target RNA. Without wishing to be bound by theory, long double stranded RNA introduced into cells is broken down into siRNA by a Type III endonuclease known as Dicer (Sharp et al., *Genes Dev.* 2001, 15:485). Dicer, a ribonuclease-III-like enzyme, processes the dsRNA into 19-23 base pair short interfering RNAs with characteristic two base 3' overhangs (Bernstein, et al., (2001) *Nature* 409:363). The siRNAs are then incorporated into an RNA-induced silencing complex (RISC) where one or more helicases unwind the siRNA duplex, enabling the complementary antisense strand to guide target recognition (Nykanen, et al., (2001) *Cell* 107:309). Upon binding to the appropriate target mRNA, one or more endonucleases within the RISC cleaves the target to induce silencing (Elbashir, et al., (2001) *Genes Dev.* 15:188). Thus, in some embodiments, the disclosure relates to a single stranded RNA that promotes the formation of a RISC complex to effect silencing of the target gene.

"G," "C," "A," "T" and "U" each generally stand for a nucleotide that contains guanine, cytosine, adenine, thymidine and uracil as a base, respectively. However, it will be understood that the terms "deoxyribonucleotide," "ribonucleotide," or "nucleotide" can also refer to a modified nucleotide, as further detailed below, or a surrogate replacement moiety. The skilled person is well aware that guanine, cytosine, adenine, and uracil may be replaced by other moieties without substantially altering the base pairing properties of an oligonucleotide comprising a nucleotide bearing such replacement moiety. For example, without limitation, a nucleotide comprising inosine as its base may base pair with nucleotides containing adenine, cytosine, or uracil. Hence, nucleotides containing uracil, guanine, or adenine may be replaced in the nucleotide sequences of dsRNA featured in the disclosure by a nucleotide containing, for example, inosine. In another example, adenine and cytosine anywhere in the oligonucleotide can be replaced with guanine and uracil, respectively to form G-U Wobble base pairing with the target mRNA. Sequences containing such replacement moieties are suitable for the compositions and methods featured in the disclosure.

As used herein, the term "iRNA," "RNAi", "iRNA agent," or "RNAi agent" or "RNAi molecule" refers to an agent that contains RNA as that term is defined herein, and which mediates the targeted cleavage of an RNA transcript, e.g., via an RNA-induced silencing complex (RISC) pathway. In some embodiments, an iRNA as described herein effects inhibition of SCN9A expression, e.g., in a cell or mammal. Inhibition of SCN9A expression may be assessed based on a reduction in the level of SCN9A mRNA or a reduction in the level of the SCN9A protein.

The term "linker" or "linking group" means an organic moiety that connects two parts of a compound, e.g., covalently attaches two parts of a compound.

The term "lipophile" or "lipophilic moiety" broadly refers to any compound or chemical moiety having an affinity for lipids. One way to characterize the lipophilicity of the lipophilic moiety is by the octanol-water partition coefficient, log $K_{ow}$, where $K_{ow}$ is the ratio of a chemical's concentration in the octanol-phase to its concentration in the aqueous phase of a two-phase system at equilibrium. The octanol-water partition coefficient is a laboratory-measured property of a substance. However, it may also be predicted by using coefficients attributed to the structural components of a chemical which are calculated using first-principle or empirical methods (see, for example, Tetko et al., *J. Chem. Inf. Comput. Sci.* 41:1407-21 (2001), which is incorporated herein by reference in its entirety). It provides a thermodynamic measure of the tendency of the substance to prefer a non-aqueous or oily milieu rather than water (i.e. its hydrophilic/lipophilic balance). In principle, a chemical substance is lipophilic in character when its log $K_{ow}$ exceeds 0. Typically, the lipophilic moiety possesses a log $K_{ow}$ exceeding 1, exceeding 1.5, exceeding 2, exceeding 3, exceeding 4, exceeding 5, or exceeding 10. For instance, the log $K_{ow}$ of 6-amino hexanol, for instance, is predicted to be approximately 0.7. Using the same method, the log $K_{ow}$ of cholesteryl N-(hexan-6-ol) carbamate is predicted to be 10.7.

The lipophilicity of a molecule can change with respect to the functional group it carries. For instance, adding a hydroxyl group or amine group to the end of a lipophilic moiety can increase or decrease the partition coefficient (e.g., log $K_{ow}$) value of the lipophilic moiety.

Alternatively, the hydrophobicity of the double-stranded RNAi agent, conjugated to one or more lipophilic moieties, can be measured by its protein binding characteristics. For instance, in certain embodiments, the unbound fraction in the plasma protein binding assay of the double-stranded RNAi agent could be determined to positively correlate to the relative hydrophobicity of the double-stranded RNAi agent, which could then positively correlate to the silencing activity of the double-stranded RNAi agent.

In some embodiments, the plasma protein binding assay determined is an electrophoretic mobility shift assay (EMSA) using human serum albumin protein. An exemplary protocol of this binding assay is illustrated in detail in, e.g., PCT/US2019/031170. The hydrophobicity of the double-stranded RNAi agent, measured by fraction of unbound siRNA in the binding assay, exceeds 0.15, exceeds 0.2, exceeds 0.25, exceeds 0.3, exceeds 0.35, exceeds 0.4, exceeds 0.45, or exceeds 0.5 for an enhanced in vivo delivery of siRNA.

Accordingly, conjugating the lipophilic moieties to the internal position(s) of the double-stranded RNAi agent provides optimal hydrophobicity for the enhanced in vivo delivery of siRNA.

The term "lipid nanoparticle" or "LNP" is a vesicle comprising a lipid layer encapsulating a pharmaceutically active molecule, such as a nucleic acid molecule, e.g., a RNAi agent or a plasmid from which a RNAi agent is transcribed. LNPs are described in, for example, U.S. Pat. Nos. 6,858,225, 6,815,432, 8,158,601, and 8,058,069, the entire contents of which are hereby incorporated herein by reference.

As used herein, the term "modulate the expression of," refers to an at least partial "inhibition" or partial "activation" of a gene (e.g., SCN9A gene) expression in a cell treated with an iRNA composition as described herein compared to the expression of the corresponding gene in a control cell. A control cell includes an untreated cell, or a cell treated with a non-targeting control iRNA.

The skilled artisan will recognize that the term "RNA molecule" or "ribonucleic acid molecule" encompasses not only RNA molecules as expressed or found in nature, but also analogs and derivatives of RNA comprising one or more ribonucleotide/ribonucleoside analogs or derivatives as described herein or as known in the art. Strictly speaking, a "ribonucleoside" includes a nucleoside base and a ribose sugar, and a "ribonucleotide" is a ribonucleoside with one, two or three phosphate moieties or analogs thereof (e.g., phosphorothioate). However, the terms "ribonucleoside" and "ribonucleotide" can be considered to be equivalent as used herein. The RNA can be modified in the nucleobase structure, in the ribose structure, or in the ribose-phosphate backbone structure, e.g., as described herein below. However, the molecules comprising ribonucleoside analogs or derivatives must retain the ability to form a duplex. As non-limiting examples, an RNA molecule can also include at least one modified ribonucleoside including but not limited to a 2'-O-methyl modified nucleoside, a nucleoside comprising a 5' phosphorothioate group, a terminal nucleoside linked to a cholesteryl derivative or dodecanoic acid bisdecylamide group, a locked nucleoside, an abasic nucleoside, an acyclic nucleoside, a glycol nucleotide, a 2'-deoxy-2'-fluoro modified nucleoside, a 2'-amino-modified nucleoside, 2'-alkyl-modified nucleoside, morpholino nucleoside, a phosphoramidate or a non-natural base comprising nucleoside, or any combination thereof. Alternatively, or in combination, an RNA molecule can comprise at least two modified ribonucleosides, at least 3, at least 4, at least 5, at least 6, at least 7, at least 8, at least 9, at least 10, at least 15, at least 20 or more, up to the entire length of the dsRNA molecule. The modifications need not be the same for each of such a plurality of modified ribonucleosides in an RNA molecule. In some embodiments, modified RNAs contemplated for use in methods and compositions described herein are peptide nucleic acids (PNAs) that have the ability to form the required duplex structure and that permit or mediate the specific degradation of a target RNA, e.g., via a RISC pathway. For clarity, it is understood that the term "iRNA" does not encompass a naturally occurring double stranded DNA molecule or a 100% deoxynucleoside-containing DNA molecule.

In some aspects, a modified ribonucleoside includes a deoxyribonucleoside. In such an instance, an iRNA agent can comprise one or more deoxynucleosides, including, for example, a deoxynucleoside overhang(s), or one or more deoxynucleosides within the double stranded portion of a dsRNA. In certain embodiments, the RNA molecule comprises a percentage of deoxyribonucleosides of at least 5, 10, 15, 20, 25, 30, 35, 40, 45, 50, 55, 60, 65, 70, 75, 80, 85, 90, 95% or higher (but not 100%) deoxyribonucleosides, e.g., in one or both strands.

As used herein, the term "nucleotide overhang" refers to at least one unpaired nucleotide that protrudes from the duplex structure of an iRNA, e.g., a dsRNA. For example, when a 3'-end of one strand of a dsRNA extends beyond the 5'-end of the other strand, or vice versa, there is a nucleotide overhang. A dsRNA can comprise an overhang of at least one nucleotide; alternatively, the overhang can comprise at least two nucleotides, at least three nucleotides, at least four nucleotides, or at least five nucleotides or more. A nucleotide overhang can comprise or consist of a nucleotide/nucleoside analog, including a deoxynucleotide/nucleoside. The overhang(s) may be on the sense strand, the antisense strand or any combination thereof. Furthermore, the nucleotide(s) of an overhang can be present on the 5' end, 3' end or both ends of either an antisense or sense strand of a dsRNA.

In some embodiments, the antisense strand of a dsRNA has a 1-10 nucleotide overhang at the 3' end and/or the 5' end. In some embodiments, the sense strand of a dsRNA has a 1-10 nucleotide overhang at the 3' end and/or the 5' end.

In some embodiments, one or more of the nucleotides in the overhang is replaced with a nucleoside thiophosphate.

As used herein, a "pharmaceutical composition" comprises a pharmacologically effective amount of a therapeutic agent (e.g., an iRNA) and a pharmaceutically acceptable carrier. As used herein, "pharmacologically effective amount," "therapeutically effective amount" or simply "effective amount" refers to that amount of an agent (e.g., iRNA) effective to produce the intended pharmacological, therapeutic or preventive result. For example, in a method of treating a disorder related to SCN9A expression (e.g., pain, e.g., chronic pain or pain-related disorder), an effective amount includes an amount effective to reduce one or more symptoms associated with the disorder (e.g., an amount effective to (a) inhibit pain or (b) inhibit or reduces the expression or activity of SCN9A) or an amount effective to reduce the risk of developing conditions associated with the disorder. For example, if a given clinical treatment is considered effective when there is at least a 10% reduction in a measurable parameter associated with a disease or disorder, a therapeutically effective amount of a drug for the treatment of that disease or disorder is the amount necessary to obtain at least a 10% reduction in that parameter. For example, a therapeutically effective amount of an iRNA targeting SCN9A can reduce a level of SCN9A mRNA or a level of SCN9A protein by any measurable amount, e.g., by at least 10%, 15%, 20%, 25%, 30%, 35%, 40%, 45%, 50%, 55%, 60%, 65%, 70%, 75%, 80%, 85%, 90%, or 95%.

The term "pharmaceutically acceptable carrier" refers to a carrier for administration of a therapeutic agent. Such carriers include, but are not limited to, saline, buffered saline, dextrose, water, glycerol, ethanol, and combinations thereof. The term specifically excludes cell culture medium. For drugs administered orally, pharmaceutically acceptable carriers include, but are not limited to pharmaceutically acceptable excipients such as inert diluents, disintegrating agents, binding agents, lubricating agents, sweetening agents, flavoring agents, coloring agents and preservatives. Suitable inert diluents include sodium and calcium carbonate, sodium and calcium phosphate, and lactose, while corn starch and alginic acid are suitable disintegrating agents. Binding agents may include starch and gelatin, while the lubricating agent, if present, will generally be magnesium stearate, stearic acid or talc. If desired, the tablets may be coated with a material such as glyceryl monostearate or glyceryl distearate, to delay absorption in the gastrointestinal tract. Agents included in drug formulations are described further herein below.

As used herein, the term "SNALP" refers to a stable nucleic acid-lipid particle. A SNALP represents a vesicle of lipids coating a reduced aqueous interior comprising a nucleic acid such as an iRNA or a plasmid from which an iRNA is transcribed. SNALPs are described, e.g., in U.S. Patent Application Publication Nos. 2006/0240093, 2007/0135372, and in International Application No. WO 2009/082817. These applications are incorporated herein by reference in their entirety. In some embodiments, the SNALP is a SPLP. As used herein, the term "SPLP" refers to a nucleic acid-lipid particle comprising plasmid DNA encapsulated within a lipid vesicle.

As used herein, the term "strand comprising a sequence" refers to an oligonucleotide comprising a chain of nucleotides that is described by the sequence referred to using the standard nucleotide nomenclature.

As used herein, a "subject" to be treated according to the methods described herein, includes a human or non-human animal, e.g., a mammal. The mammal may be, for example, a rodent (e.g., a rat or mouse) or a primate (e.g., a monkey). In some embodiments, the subject is a human.

A "subject in need thereof" includes a subject having, suspected of having, or at risk of developing a disorder related to SCN9A expression, e.g., overexpression (e.g., pain, e.g., chronic pain or a pain-related disorder). In some embodiments, the subject has, or is suspected of having, a disorder related to SCN9A expression or overexpression. In some embodiments, the subject is at risk of developing a disorder related to SCN9A expression or overexpression.

As used herein, "target sequence" refers to a contiguous portion of the nucleotide sequence of an mRNA molecule formed during the transcription of a gene, e.g., SCN9A, including mRNA that is a product of RNA processing of a primary transcription product. The target portion of the sequence will be at least long enough to serve as a substrate for iRNA-directed cleavage at or near that portion. For example, the target sequence will generally be from 9-36 nucleotides in length, e.g., 15-30 nucleotides in length, including all sub-ranges therebetween. As non-limiting examples, the target sequence can be from 15-30 nucleotides, 15-26 nucleotides, 15-23 nucleotides, 15-22 nucleotides, 15-21 nucleotides, 15-20 nucleotides, 15-19 nucleotides, 15-18 nucleotides, 15-17 nucleotides, 18-30 nucleotides, 18-26 nucleotides, 18-23 nucleotides, 18-22 nucleotides, 18-21 nucleotides, 18-20 nucleotides, 19-30 nucleotides, 19-26 nucleotides, 19-23 nucleotides, 19-22 nucleotides, 19-21 nucleotides, 19-20 nucleotides, 20-30 nucleotides, 20-26 nucleotides, 20-25 nucleotides, 20-24 nucleotides, 20-23 nucleotides, 20-22 nucleotides, 20-21 nucleotides, 21-30 nucleotides, 21-26 nucleotides, 21-25 nucleotides, 21-24 nucleotides, 21-23 nucleotides, or 21-22 nucleotides.

As used herein, the phrases "therapeutically effective amount" and "prophylactically effective amount" and the like refer to an amount that provides a therapeutic benefit in the treatment, prevention, or management of any disorder or pathological process related to SCN9A expression (e.g., pain, e.g., chronic pain or a pain-related disorder). The specific amount that is therapeutically effective may vary depending on factors known in the art, such as, for example, the type of disorder or pathological process, the patient's history and age, the stage of the disorder or pathological process, and the administration of other therapies.

In the context of the present disclosure, the terms "treat," "treatment," and the like mean to prevent, delay, relieve or alleviate at least one symptom associated with a disorder related to SCN9A expression, or to slow or reverse the progression or anticipated progression of such a disorder. For example, the methods featured herein, when employed to treat pain, e.g., chronic pain or a pain-related disorder, may serve to reduce or prevent one or more symptoms of the pain, e.g., chronic pain, as described herein, or to reduce the risk or severity of associated conditions. Thus, unless the context clearly indicates otherwise, the terms "treat," "treatment," and the like are intended to encompass prophylaxis, e.g., prevention of disorders and/or symptoms of disorders related to SCN9A expression. Treatment can also mean prolonging survival as compared to expected survival in the absence of treatment.

By "lower" in the context of a disease marker or symptom is meant any decrease, e.g., a statistically or clinically significant decrease in such level. The decrease can be, for example, at least 10%, at least 20%, at least 30%, at least 40%, at least 40%, at least 50%, at least 60%, at least 70%, at least 80%, or at least 90%. The decrease can be down to a level accepted as within the range of normal for an individual without such disorder.

As used herein, "SCN9A" refers to "sodium channel, voltage gated, type IX alpha subunit" gene ("SCN9A gene"), the corresponding mRNA ("SCN9A mRNA"), or the corresponding protein ("SCN9A protein"). The sequence of a human SCN9A mRNA transcript can be found at SEQ ID NO: 1 or SEQ ID NO: 4001.

In the event of a discrepancy between the recited positions of the duplexes presented herein and the alignment of the duplexes to the recited sequences, the alignment of the duplexes to the recited sequence will govern.

II. iRNA Agents

Described herein are iRNA agents that modulate (e.g., inhibit) the expression of SCN9A.

In some embodiments, the iRNA agent activates the expression of SCN9A in a cell or mammal.

In some embodiments, the iRNA agent includes double-stranded ribonucleic acid (dsRNA) molecules for inhibiting the expression of SCN9A in a cell or in a subject (e.g., in a mammal, e.g., in a human), where the dsRNA includes an antisense strand having a region of complementarity which is complementary to at least a part of an mRNA formed in the expression of SCN9A, and where the region of complementarity is 30 nucleotides or less in length, generally 19-24 nucleotides in length, and where the dsRNA, upon contact with a cell expressing SCN9A, inhibits the expression of SCN9A, e.g., by at least 10%, 20%, 30%, 40%, or 50%.

The modulation (e.g., inhibition) of expression of SCN9A can be assayed by, for example, a PCR or branched DNA (bDNA)-based method, or by a protein-based method, such as by Western blot. Expression of SCN9A in cell culture, such as in COS cells, ARPE-19 cells, hTERT RPE-1 cells, HeLa cells, primary hepatocytes, HepG2 cells, primary cultured cells or in a biological sample from a subject can be assayed by measuring SCN9A mRNA levels, such as by bDNA or TaqMan assay, or by measuring protein levels, such as by immunofluorescence analysis, using, for example, Western Blotting or flow cytometric techniques.

A dsRNA typically includes two RNA strands that are sufficiently complementary to hybridize to form a duplex structure under conditions in which the dsRNA will be used. One strand of a dsRNA (the antisense strand) typically includes a region of complementarity that is substantially complementary, and generally fully complementary, to a target sequence, derived from the sequence of an mRNA formed during the expression of SCN9A. The other strand (the sense strand) typically includes a region that is complementary to the antisense strand, such that the two strands hybridize and form a duplex structure when combined under suitable conditions. Generally, the duplex structure is between 15 and 30 inclusive, more generally between 18 and 25 inclusive, yet more generally between 19 and 24 inclusive, and most generally between 19 and 21 base pairs in length, inclusive. Similarly, the region of complementarity to the target sequence is between 15 and 30 inclusive, more generally between 18 and 25 inclusive, yet more generally between 19 and 24 inclusive, and most generally between 19 and 21 nucleotides in length, inclusive.

In some embodiments, the dsRNA is between 15 and 20 nucleotides in length, inclusive, and in other embodiments, the dsRNA is between 25 and 30 nucleotides in length, inclusive. As the ordinarily skilled person will recognize, the targeted region of an RNA targeted for cleavage will most often be part of a larger RNA molecule, often an mRNA molecule. Where relevant, a "part" of an mRNA target is a contiguous sequence of an mRNA target of sufficient length to be a substrate for RNAi-directed cleavage (i.e., cleavage through a RISC pathway). dsRNAs having duplexes as short as 9 base pairs can, under some circumstances, mediate RNAi-directed RNA cleavage. Most often a target will be at least 15 nucleotides in length, e.g., 15-30 nucleotides in length.

One of skill in the art will also recognize that the duplex region is a primary functional portion of a dsRNA, e.g., a duplex region of 9 to 36, e.g., 15-30 base pairs. Thus, in some embodiments, to the extent that it becomes processed to a functional duplex of e.g., 15-30 base pairs that targets a desired RNA for cleavage, an RNA molecule or complex of RNA molecules having a duplex region greater than 30 base pairs is a dsRNA. Thus, an ordinarily skilled artisan will recognize that in some embodiments, then, an miRNA is a dsRNA. In some embodiments, a dsRNA is not a naturally occurring miRNA. In some embodiments, an iRNA agent useful to target SCN9A expression is not generated in the target cell by cleavage of a larger dsRNA.

A dsRNA as described herein may further include one or more single-stranded nucleotide overhangs. The dsRNA can be synthesized by standard methods known in the art as further discussed below, e.g., by use of an automated DNA synthesizer, such as are commercially available from, for example, Biosearch, Applied Biosystems, Inc.

In some embodiments, SCN9A is a human SCN9A.

In specific embodiments, the dsRNA comprises a sense strand that comprises or consists of a sense sequence selected from the sense sequences provided in Tables 2A, 2B, 4A, 4B, 5A, 5B, 6A, 6B, 13A, 13B, 14A, 14B, 15A, 15B, 16, 18, or 20 and an antisense strand that comprises or consists of an antisense sequence selected from the antisense sequences provided in Tables 2A, 2B, 4A, 4B, 5A, 5B, 6A, 6B, 13A, 13B, 14A, 14B, 15A, 15B, 16, 18, or 20.

In some aspects, a dsRNA will include at least sense and antisense nucleotide sequences, whereby the sense strand is selected from the sequences provided in Tables 2A, 2B, 4A, 4B, 5A, 5B, 6A, 6B, 13A, 13B, 14A, 14B, 15A, 15B, 16, 18, or 20 and the corresponding antisense strand is selected from the sequences provided in Tables 2A, 2B, 4A, 4B, 5A, 5B, 6A, 6B, 13A, 13B, 14A, 14B, 15A, 15B, 16, 18, or 20.

In these aspects, one of the two sequences is complementary to the other of the two sequences, with one of the sequences being substantially complementary to a sequence of an mRNA generated by the expression of SCN9A. As such, a dsRNA will include two oligonucleotides, where one oligonucleotide is described as the sense strand, and the second oligonucleotide is described as the corresponding antisense strand. As described elsewhere herein and as known in the art, the complementary sequences of a dsRNA can also be contained as self-complementary regions of a single nucleic acid molecule, as opposed to being on separate oligonucleotides.

The skilled person is well aware that dsRNAs having a duplex structure of between 20 and 23, but specifically 21, base pairs have been hailed as particularly effective in inducing RNA interference (Elbashir et al., *EMBO* 2001, 20:6877-6888). However, others have found that shorter or longer RNA duplex structures can be effective as well.

In the embodiments described above, by virtue of the nature of the oligonucleotide sequences provided in Tables 2A, 2B, 4A, 4B, 5A, 5B, 6A, 6B, 13A, 13B, 14A, 14B, 15A, 15B, 16, 18, and 20, dsRNAs described herein can include at least one strand of a length of minimally 19 nucleotides. It can be reasonably expected that shorter duplexes having one of the sequences of Tables 2A, 2B, 4A, 4B, 5A, 5B, 6A, 6B, 13A, 13B, 14A, 14B, 15A, 15B, 16, 18, and 20 minus only a few nucleotides on one or both ends will be similarly effective as compared to the dsRNAs described above.

In some embodiments, the dsRNA has a partial sequence of at least 15, 16, 17, 18, 19, 20, or more contiguous nucleotides from one of the sequences of Tables 2A, 2B, 4A, 4B, 5A, 5B, 6A, 6B, 13A, 13B, 14A, 14B, 15A, 15B, 16, 18, or 20.

In some embodiments, the dsRNA has an antisense sequence that comprises at least 15, 16, 17, 18, or 19 contiguous nucleotides of an antisense sequence provided in Tables 2A, 2B, 4A, 4B, 5A, 5B, 6A, 6B, 13A, 13B, 14A, 14B, 15A, 15B, 16, 18, or 20 and a sense sequence that comprises at least 15, 16, 17, 18, or 19 contiguous nucleotides of a corresponding sense sequence provided in Tables 2A, 2B, 4A, 4B, 5A, 5B, 6A, 6B, 13A, 13B, 14A, 14B, 15A, 15B, 16, 18, or 20.

In some embodiments, the dsRNA comprises an antisense sequence that comprises at least 15, 16, 17, 18, 19, 20, 21, 22, or 23 contiguous nucleotides of an antisense sequence provided in Tables 2A, 2B, 4A, 4B, 5A, 5B, 6A, 6B, 13A, 13B, 14A, 14B, 15A, 15B, 16, 18, or 20 and a sense sequence that comprises at least 15, 16, 17, 18, 19, 20, or 21 contiguous nucleotides of a corresponding sense sequence provided in Tables 2A, 2B, 4A, 4B, 5A, 5B, 6A, 6B, 13A, 13B, 14A, 14B, 15A, 15B, 16, 18, or 20.

In some such embodiments, the dsRNA, although it comprises only a portion of the sequences provided in Tables 2A, 2B, 4A, 4B, 5A, 5B, 6A, 6B, 13A, 13B, 14A, 14B, 15A, 15B, 16, 18, or 20 is equally effective in inhibiting a level of SCN9A expression as is a dsRNA that comprises the full-length sequences provided in Tables 2A, 2B, 4A, 4B, 5A, 5B, 6A, 6B, 13A, 13B, 14A, 14B, 15A, 15B, 16, 18, or 20. In some embodiments, the dsRNA differs in its inhibition of a level of expression of SCN9A by not more than 5, 10, 15, 20, 25, 30, 35, 40, 45, or 50% inhibition compared with a dsRNA comprising the full sequence disclosed herein.

In some embodiments, an iRNA of Table 2A, 2B, 4A, 4B, 5A, 5B, 6A, 6B, 13A, 13B, 14A, 14B, 15A, 15B, 16, 18, or 20 decreases SCN9A protein or SCN9A mRNA levels in a cell. In some embodiments, the cell is a rodent cell (e.g., a rat cell), or a primate cell (e.g., a cynomolgus monkey cell or a human cell). In some embodiments, SCN9A protein or SCN9A mRNA levels are reduced by at least 30%, 40%, 50%, 60%, 70%, 80%, 90%, or 95%. In some embodiments, the iRNA of Table 2A, 2B, 4A, 4B, 5A, 5B, 6A, 6B, 13A, 13B, 14A, 14B, 15A, 15B, 16, 18, or 20 that inhibits SCN9A in a human cell has less than 5, 4, 3, 2, or 1 mismatches to the corresponding portion of human SCN9A. In some embodiments, the iRNA of Table 2A, 2B, 4A, 4B, 5A, 5B, 6A, 6B, 13A, 13B, 14A, 14B, 15A, 15B, 16, 18, and 20 that inhibits SCN9A in a human cell has no mismatches to the corresponding portion of human SCN9A.

iRNAs designed based on human sequences can have utility, e.g., for inhibiting SCN9A in human cells, e.g., for therapeutic purposes, or for inhibiting SCN9A in rodent cells, e.g., for research characterizing SCN9A in a rodent model.

In some embodiments, an iRNA described herein comprises an antisense strand comprising at least 15 contiguous nucleotides, with 0, 1, 2, or 3 mismatches, of a portion of nucleotide sequence of SEQ ID NO: 2. In some embodiments, an iRNA described herein comprises a sense strand comprising at least 15 contiguous nucleotides, with 0, or 1, 2, or 3 mismatches, of the corresponding portion of the nucleotide sequence of SEQ ID NO: 1.

A human SCN9A mRNA may have the sequence of SEQ ID NO: 1 provided herein.

*Homo sapiens* Sodium Channel, Voltage Gated, Type IX Alpha Subunit (SCN9A), Transcript Variant 1, mRNA (SEQ ID NO: 1)

```
CGGGGCUGCUACCUCCACGGGCGCGCCCUGGCAGGAGGGGCGCAGUCUGCUUGCAGGCGGUCGCCAGCGC

UCCAGCGGCGGCUGUCGGCUUUCCAAUUCCGCCAGCUCGGCUGAGGCUGGGCUAGCCUGGGUGCCAGUGG

CUGCUAGCGGCAGGCGUCCCCUGAGCAACAGGAGCCCAGAGAAAAAGAAGCAGCCCUGAGAGAGCGCCGG

GGAAGGAGAGGCCCGCGCCCUCUCCUGGAGCCAGAUUCUGCAGGUGCACUGGGUGGGGAUGAUCGGCGGG

CUAGGUUGCAAGCCUCUUAUGUGAGGAGCUGAAGAGGAAUUAAAAUAUACAGGAUGAAAAGAUGGCAAUG

UUGCCUCCCCCAGGACCUCAGAGCUUUGUCCAUUUCACAAAACAGUCUCUUGCCCUCAUUGAACAACGCA

UUGCUGAAAGAAAAUCAAAGGAACCCAAAGAAGAAAAGAAAGAUGAUGAUGAAGAAGCCCCAAAGCCAAG

CAGUGACUUGGAAGCUGGCAAACAGCUGCCCUUCAUCUAUGGGGACAUUCCUCCCGGCAUGGUGUCAGAG

CCCCUGGAGGACUUGGACCCCUACUAUGCAGACAAAAAGACUUUCAUAGUAUUGAACAAAGGGAAAACAA

UCUUCCGUUUCAAUGCCACACCUGCUUUAUAUAUGCUUUCUCCUUUCAGUCCUCUAAGAAGAAUAUCUAU

UAAGAUUUUAGUACACUCCUUAUUCAGCAUGCUCAUCAUGUGCACUAUUCUGACAAACUGCAUAUUUAUG

ACCAUGAAUAACCCACCGGACUGGACCAAAAAUGUCGAGUACACUUUUACUGGAAUAUAUACUUUUGAAU

CACUUGUAAAAAUCCUUGCAAGAGGCUUCUGUGUAGGAGAAUUCACUUUUCUUCGUGACCCGUGGAACUG

GCUGGAUUUUGUCGUCAUUGUUUUUGCGUAUUUAACAGAAUUUGUAAACCUAGGCAAUGUUUCAGCUCUU

CGAACUUUCAGAGUAUUGAGAGCUUUGAAAACUAUUUCUGUAAUCCCAGGCCUGAAGACAAUUGUAGGGG

CUUUGAUCCAGUCAGUGAAGAAGCUUUCUGAUGUCAUGAUCCUGACUGUGUUCUGUCUGAGUGUGUUUGC

ACUAAUUGGACUACAGCUGUUCAUGGGAAACCUGAAGCAUAAAUGUUUUCGAAAUUCACUUGAAAAUAAU

GAAACAUUAGAAAGCAUAAUGAAUACCCUAGAGAGUGAAGAAGACUUUAGAAAAUAUUUUUAUUACUUGG
```

-continued

AAGGAUCCAAAGAUGCUCUCCUUUGUGGUUUCAGCACAGAUUCAGGUCAGUGUCCAGAGGGGUACACCUG

UGUGAAAAUUGGCAGAAACCCUGAUUAUGGCUACACGAGCUUUGACACUUUCAGCUGGGCCUUCUUAGCC

UUGUUUAGGCUAAUGACCCAAGAUUACUGGGAAAACCUUUACCAACAGACGCUGCGUGCUGCUGGCAAAA

CCUACAUGAUCUUCUUUGUCGUAGUGAUUUUCCUGGGCUCCUUUUAUCUAAUAAACUUGAUCCUGGCUGU

GGUUGCCAUGGCAUAUGAAGAACAGAACCAGGCAAACAUUGAAGAAGCUAAACAGAAAGAAUUAGAAUUU

CAACAGAUGUUAGACCGUCUUAAAAAAGAGCAAGAAGAAGCUGAGGCAAUUGCAGCGGCAGCGGCUGAAU

AUACAAGUAUUAGGAGAAGCAGAAUUAUGGGCCUCUCAGAGAGUUCUUCUGAAACAUCCAAACUGAGCUC

UAAAAGUGCUAAAGAAAGAAGAAACAGAAGAAAGAAAAAGAAUCAAAAGAAGCUCUCCAGUGGAGAGGAA

AAGGGAGAUGCUGAGAAAUUGUCGAAAUCAGAAUCAGAGGACAGCAUCAGAAGAAAAAGUUUCCACCUUG

GUGUCGAAGGGCAUAGGCGAGCACAUGAAAAGAGGUUGUCUACCCCCAAUCAGUCACCACUCAGCAUUCG

UGGCUCCUUGUUUUCUGCAAGGCGAAGCAGCAGAACAAGUCUUUUUAGUUUCAAAGGCAGAGGAAGAGAU

AUAGGAUCUGAGACUGAAUUUGCCGAUGAUGAGCACAGCAUUUUUGGAGACAAUGAGAGCAGAAGGGGCU

CACUGUUUGUGCCCCACAGACCCCAGGAGCGACGCAGCAGUAACAUCAGCCAAGCCAGUAGGUCCCCACC

AAUGCUGCCGGUGAACGGGAAAAUGCACAGUGCUGUGGACUGCAACGGUGUGGUCUCCCUGGUUGAUGGA

CGCUCAGCCCUCAUGCUCCCCAAUGGACAGCUUCUGCCAGAGGGCACGACCAAUCAAAUACACAAGAAAA

GGCGUUGUAGUUCCUAUCUCCUUUCAGAGGAUAUGCUGAAUGAUCCCAACCUCAGACAGAGAGCAAUGAG

UAGAGCAAGCAUAUUAACAAACACUGUGGAAGAACUUGAAGAGUCCAGACAAAAAUGUCCACCUUGGUGG

UACAGAUUUGCACACAAAUUCUUGAUCUGGAAUUGCUCUCCAUAUUGGAUAAAAUUCAAAAAGUGUAUCU

AUUUUAUUGUAAUGGAUCCUUUUGUAGAUCUUGCAAUUACCAUUUGCAUAGUUUUAAACACAUUAUUUAU

GGCUAUGGAACACCACCCAAUGACUGAGGAAUUCAAAAAUGUACUUGCUAUAGGAAAUUUGGUCUUUACU

GGAAUCUUUGCAGCUGAAAUGGUAUUAAAACUGAUUGCCAUGGAUCCAUAUGAGUAUUUCCAAGUAGGCU

GGAAUAUUUUUGACAGCCUUAUUGUGACUUUAAGUUUAGUGGAGCUCUUUCUAGCAGAUGUGGAAGGAUU

GUCAGUUCUGCGAUCAUUCAGACUGCUCCGAGUCUUCAAGUUGGCAAAAUCCUGGCCAACAUUGAACAUG

CUGAUUAAGAUCAUUGGUAACUCAGUAGGGGCUCUAGGUAACCUCACCUUAGUGUUGGCCAUCAUCGUCU

UCAUUUUUGCUGUGGUCGGCAUGCAGCUCUUUGGUAAGAGCUACAAAGAAUGUGUCUGCAAGAUCAAUGA

UGACUGUACGCUCCCACGGUGGCACAUGAACGACUUCUUCCACUCCUUCCUGAUUGUGUUCCGCGUGCUG

UGUGGAGAGUGGAUAGAGACCAUGUGGGACUGUAUGGAGGUCGCUGGUCAAGCUAUGUGCCUUAUUGUUU

ACAUGAUGGUCAUGGUCAUUGGAAACCUGGUGGUCCUAAACCUAUUUCUGGCCUUAUUAUUGAGCUCAUU

UAGUUCAGACAAUCUUACAGCAAUUGAAGAAGACCCUGAUGCAAACAACCUCCAGAUUGCAGUGACUAGA

AUUAAAAAGGGAAUAAAUUAUGUGAAACAAACCUUACGUGAAUUUAUUCUAAAAGCAUUUUCCAAAAAGC

CAAAGAUUUCCAGGGAGAUAAGACAAGCAGAAGAUCUGAAUACUAAGAAGGAAAACUAUAUUUCUAACCA

UACACUUGCUGAAAUGAGCAAAGGUCACAAUUUCCUCAAGGAAAAAGAUAAAAUCAGUGGUUUUGGAAGC

AGCGUGGACAAACACUUGAUGGAAGACAGUGAUGGUCAAUCAUUUAUUCACAAUCCCAGCCUCACAGUGA

CAGUGCCAAUUGCACCUGGGGAAUCCGAUUUGGAAAAUAUGAAUGCUGAGGAACUUAGCAGUGAUUCGGA

UAGUGAAUACAGCAAAGUGAGAUUAAACCGGUCAAGCUCCUCAGAGUGCAGCACAGUUGAUAACCCUUUG

CCUGGAGAAGGAGAAGAAGCAGAGGCUGAACCUAUGAAUUCCGAUGAGCCAGAGGCCUGUUUCACAGAUG

GUUGUGUACGGAGGUUCUCAUGCUGCCAAGUUAACAUAGAGUCAGGGAAAGGAAAAAUCUGGUGGAACAU

CAGGAAAACCUGCUACAAGAUUGUUGAACACAGUUGGUUUGAAAGCUUCAUUGUCCUCAUGAUCCUGCUC

AGCAGUGGUGCCCUGGCUUUUGAAGAUAUUUAUAUUGAAAGGAAAAAGACCAUUAAGAUUAUCCUGGAGU

AUGCAGACAAGAUCUUCACUUACAUCUUCAUUCUGGAAAUGCUUCUAAAAUGGAUAGCAUAUGGUUAUAA

-continued

AACAUAUUUCACCAAUGCCUGGUGUUGGCUGGAUUUCCUAAUUGUUGAUGUUUCUUUGGUUACUUUAGUG

GCAAACACUCUUGGCUACUCAGAUCUUGGCCCCAUUAAAUCCCUUCGGACACUGAGAGCUUUAAGACCUC

UAAGAGCCUUAUCUAGAUUUGAAGGAAUGAGGGUCGUUGUGAAUGCACUCAUAGGAGCAAUUCCUUCCAU

CAUGAAUGUGCUACUUGUGUGUCUUAUAUUCUGGCUGAUAUUCAGCAUCAUGGGAGUAAAUUUGUUUGCU

GGCAAGUUCUAUGAGUGUAUUAACACCACAGAUGGGUCACGGUUUCCUGCAAGUCAAGUUCCAAAUCGUU

CCGAAUGUUUUGCCCUUAUGAAUGUUAGUCAAAAUGUGCGAUGGAAAAACCUGAAAGUGAACUUUGAUAA

UGUCGGACUUGGUUACCUAUCUCUGCUUCAAGUUGCAACUUUUAAGGGAUGGACGAUUAUUAUGUAUGCA

GCAGUGGAUUCUGUUAAUGUAGACAAGCAGCCCAAAUAUGAAUAUAGCCUCUACAUGUAUAUUUAUUUUG

UCGUCUUUAUCAUCUUUGGGUCAUUCUUCACUUUGAACUUGUUCAUUGGUGUCAUCAUAGAUAAUUUCAA

CCAACAGAAAAAGAAGCUUGGAGGUCAAGACAUCUUUAUGACAGAAGAACAGAAGAAAUACUAUAAUGCA

AUGAAAAAGCUGGGGUCCAAGAAGCCACAAAAGCCAAUUCCUCGACCAGGGAACAAAAUCCAAGGAUGUA

UAUUUGACCUAGUGACAAAUCAAGCCUUUGAUAUUAGUAUCAUGGUUCUUAUCUGUCUCAACAUGGUAAC

CAUGAUGGUAGAAAAGGAGGGUCAAAGUCAACAUAUGACUGAAGUUUUAUAUUGGAUAAAUGUGGUUUUU

AUAAUCCUUUUCACUGGAGAAUGUGUGCUAAAACUGAUCUCCCUCAGACACUACUACUUCACUGUAGGAU

GGAAUAUUUUUGAUUUUGUGGUUGUGAUUAUCUCCAUUGUAGGUAUGUUUCUAGCUGAUUUGAUUGAAAC

GUAUUUUGUGUCCCCUACCCUGUUCCGAGUGAUCCGUCUUGCCAGGAUUGGCCGAAUCCUACGUCUAGUC

AAAGGAGCAAAGGGGAUCCGCACGCUGCUCUUUGCUUUGAUGAUGUCCCUUCCUGCGUUGUUUAACAUCG

GCCUCCUGCUCUUCCUGGUCAUGUUCAUCUACGCCAUCUUUGGAAUGUCCAACUUUGCCUAUGUUAAAAA

GGAAGAUGGAAUUAAUGACAUGUUCAAUUUUGAGACCUUUGGCAACAGUAUGAUUUGCCUGUUCCAAAUU

ACAACCUCUGCUGGCUGGGAUGGAUUGCUAGCACCUAUUCUUAACAGUAAGCCACCCGACUGUGACCCAA

AAAAAGUUCAUCCUGGAAGUUCAGUUGAAGGAGACUGUGGUAACCCAUCUGUUGGAAUAUUCUACUUUGU

UAGUUAUAUCAUCAUAUCCUUCCUGGUUGUGGUGAACAUGUACAUUGCAGUCAUACUGGAGAAUUUUAGU

GUUGCCACUGAAGAAAGUACUGAACCUCUGAGUGAGGAUGACUUUGAGAUGUUCUAUGAGGUUUGGGAGA

AGUUUGAUCCCGAUGCGACCCAGUUUAUAGAGUUCUCUAAACUCUCUGAUUUUGCAGCUGCCCUGGAUCC

UCCUCUUCUCAUAGCAAAACCCAACAAAGUCCAGCUCAUUGCCAUGGAUCUGCCCAUGGUUAGUGGUGAC

CGGAUCCAUUGUCUUGACAUCUUAUUUGCUUUUACAAAGCGUGUUUUGGGUGAGAGUGGGGAGAUGGAUU

CUCUUCGUUCACAGAUGGAAGAAAGGUUCAUGUCUGCAAAUCCUUCCAAAGUGUCCUAUGAACCCAUCAC

AACCACACUAAAACGGAAACAAGAGGAUGUGUCUGCUACUGUCAUUCAGCGUGCUUAUAGACGUUACCGC

UUAAGGCAAAAUGUCAAAAAUAUAUCAAGUAUAUACAUAAAAGAUGGAGACAGAGAUGAUGAUUUACUCA

AUAAAAAAGAUAUGGCUUUUGAUAAUGUUAAUGAGAACUCAAGUCCAGAAAAAACAGAUGCCACUUCAUC

CACCACCUCUCCACCUUCAUAUGAUAACAAAGCCAGACAAAGAGAAAUAUGAACAAGACAGAACAGAAAA

GGAAGACAAAGGGAAAGACAGCAAGGAAAGCAAAAAAUAGAGCUUCAUUUUUGAUAUAUUGUUUACAGCC

UGUGAAAGUGAUUUAUUUGUGUUAAUAAAACUCUUUUGAGGAAGUCUAUGCCAAAAUCCUUUUUAUCAAA

AUAUUCUCGAAGGCAGUGCAGUCACUAACUCUGAUUUCCUAAGAAAGGUGGGCAGCAUUAGCAGAUGGUU

AUUUUUGCACUGAUGAUUCUUUAAGAAUCGUAAGAGAACUCUGUAGGAAUUAUUGAUUAUAGCAUACAAA

AGUGAUUCAGUUUUUUGGUUUUUAAUAAAUCAGAAGACCAUGUAGAAAACUUUUACAUCUGCCUUGUCAU

CUUUUCACAGGAUUGUAAUUAGUCUUGUUUCCCAUGUAAAUAAACAACACACGCAUACAGAAAAAUCUAU

UAUUUAUCUAUUAUUUGGAAAUCAACAAAAGUAUUUGCCUUGGCUUUGCAAUGAAAUGCUUGAUAGAAGU

AAUGGACAUUAGUUAUGAAUGUUUAGUUAAAAUGCAUUAUUAGGGAGCUUGACUUUUUAUCAAUGUACAG

AGGUUAUUCUAUAUUUUGAGGUGCUUAAAUUUAUUCUACAUUGCAUCAGAACCAAUUUAUAUGUGCCUAU

AAAAUGCCAUGGGAUUAAAAAUAUAUGUAGGCUAUUCAUUUCUACAAAUGUUUUUCAUUCAUCUUGACUC

-continued

ACAUGCCAACAAGGAUAAGACUUACCUUUAGAGUAUUGUGUUUCAUAGCCUUUCUUCUUUCAUAUCCCUU

UUUGUUCAUAGAAUAACCACAGAACUUGAAAAAUUAUUCUAAGUACAUAUUACACUCCUCAAAAAAAACA

AAGAUAACUGAGAAAAAAGUUAUUGACAGAAGUUCUAUUUGCUAUUAUUUACAUAGCCUAACAUUUGACU

GUGCUGCCCAAAAUACUGAUAAUAGUCUCUUAAACUCUUUUGUCAAAUUUUCCUGCUUUCUUAUGCAGUA

UUGUUUAGUCAUCCUUUCGCUGUAAGCAAAGUUGAUGAAAUCCUUCCUGAUAUGCAGUUAGUUGUUUGAC

CACGGUACAUACUUGAGCAGAUAAUAACUUGGGCACAGUAUUUAUUGCAUCACUUGUAUACAAUCCCGUG

UUUGGCAAGCUUUCAAAUCAUGUAAUAUGACAGACUUUACACAGAUAUGUGUUUAGUAUGAAUAAAAAAG

CAUUGAAAUAGGGAUUCUUGCCAACUUGCUCUCUUGCCACCAACUUACUUUCCUAAAUUAUGGAAGUAAU

CUUUUUUGGAUAUACUUCAAUGUAUACAAUGAGGAAGAUGUCACCUUCUCCUUAAAAUUCUAUGAUGUGA

AAUAUAUUUUGCCUCAAUCAACACAGUACCAUGGGCUUCUAAUUUAUCAAGCACAUAUUCAUUUUGCAUU

AGCUGUAGACAUCUAGUUUUUUGAAAACACCUAUUAAUAGUAAUUUGAAAAGAAAUAACCAUAAUGCUUU

UUUUCGUGAGUUUAUUUCAGGAAUAUGAGAUCUUUCUUCUAUAAAGUUAUUCAUGCACAGGCAAAAAUUG

AGCUACACAGGUAGAAUGUAGUUUUACUUAGAAGAUUUUUGUGGGAGGUUUUGAAGCAAAUAUAUAAAAC

AACUUUCACUAAUUUGCUUUCCAUAUUUAAAAAAUAAUAAAUUACAUUUAUAUAAUAAAUGUUUAAAGCA

CAUAUUUUUUGUUGUUCUGGCAAUUUAAAAAGAAAGAGGAUUUAAACGUACCUAUAGAAACAAAGAUUUA

UGGUUAAAGAAUGAGAUCAGAAGUCUAGAAUGUUUUUAAAUUGUGAUAUAUUUUACAACAUCCGUUAUUA

CUUUGAGACAUUUGUCCUAAUCUACGUAUAAAACUCAAUCUAGGGCUAAAGAUUCUUUAUACCAUCUUAG

GUUCAUUCAUCUUAGGCUAUUUGAACCACUUUUUAAUUUAAUAUGAAAGACACCAUGCAGUGUUUUCCGA

GACUACAUAGAUCAUUUUAUCACAUACCUACCAAGCCUGUUGGAAAUAGGUUUUGAUAAUUUAAGUAGGG

ACCUAUACAAAAUAUAUUACAUUUAUCAGAUUUUUAAAUACAUUCAAUUAAGAAUUUAACAUCACCUUAA

AUUUGAAUUCAAUCUACCGUUAUUUCAAACUCACAAAUAUAACUGCAUUAUGAAUACUUACAUAAUGUAG

UAAGACAAGAUGUUUGACAGGUUCGUGUGUAAUUUUCUAUUAAUGUUUUUACAUUGCCUUGUUUUUAUGU

AAAAUAAAAAAUAUGGGCAACUGGUUUGUUAACAACACAAUUUCUUCUUAGCAUUUCAAAAAUAUAUAUA

AAGUUGUUCUUUUUCCUAUUUCAUGAACUAUGUUUUUUUUUAAAAUAACAUGGUUAAGUUUUAUAUAUAU

UUACGUUUGUUUCAGGAAUGUCUACUUGUGACUUUUUAUCAAUUAAAAAUAAUAUUUGGAAGAAAGAGCU

UAUUAAGUAUAAGCUUGAAGUAAAAUUAGACCUCUCUUUCCAUGUAGAUUACUGUUUGUACUGAUGGUUU

CACCCUUCAGAAGGCACUGUCAUAUUAAUAUUUAAAUUUUAUAAUCGCUGAACUUAUUACACCCAACAAU

ACAGAAAGGCAGUUACACUGAAGAACUUAACUUAGAAUAAAAUGGAAGCAAACAGGUUUUCUAAAAACUU

UUUUAAGUGACCAGGUCUCGCUCUGUCACCCAGGCUAGAGUGCAAUGGCAUGAUCAUAGCUCUCUGCAGC

CUCAACUCUGGGCUCAAGCAACCCUCCUGCCUCAGCCUCCCAAGUAGCUAAGACUACAGGUACAUGCCAC

CAUGCCUGGCUAAUAUUUAAAUUUUUGUAGAUAAGGGGUCUUGCUAUGUUGCCCAGGCUAGUCUCAAACU

CCUGGCUUCAAGUGUUCCUACUGUCAUGACCUGCCAACAUGCUGGGGUUACAGGCAUGAGCCACCAUGCC

CCAAACAGGUUUGAACACAAAUCUUUCGGAUGAAAAUUAGAGAACCUAAUUUUAGCUUUUUGAUAGUUAC

CUAGUUUGCAAAAGAUUUGGGUGACUUGUGAGCUGUUUUUAAAUGCUGAUUGUUGAACAUCACAACCCAA

AAUACUUAGCAUGAUUUUAUAGAGUUUUGAUAGCUUUAUUAAAAAGAGUGAAAAUAAAAUGCAUAUGUAA

AUAAAGCAGUUCUAAAUAGCUAUUUCAGAGAAAUGUUAAUAGAAGUGCUGAAAGAAGGGCCAACUAAAUU

AGGAUGGCCAGGGAAUUGGCCUGGGUUUAGGACCUAUGUAUGAAGGCCACCAAUUUUUUAAAAAUAUCUG

UGGUUUAUUAUGUUAUUAUCUUCUUGAGGAAAACAAUCAAGAAUUGCUUCAUGAAAAUAAAUAAAUAGCC

AUGAAUAUCAUAAAGCUGUUUACAUAGGAUUCUUUACAAAUUUCAUAGAUCUAUGAAUGCUCAAAAUGUU

-continued

UGAGUUUGCCAUAAAUUAUAUUGUAGUUAUAUUGUAGUUAUACUUGAGACUGACACAUUGUAAUAUAAUC

UAAGAAUAAAAGUUAUACAAAAUAAAAAAAAAAAAA

The reverse complement of SEQ ID NO: 1 is provided as SEQ ID NO: 2 herein:

(SEQ ID NO: 2)

UUUUUUUUUUUUUAUUUUGUAUAACUUUUAUUCUUAGAUUAUAUUACAAUGUGUCAGUCUCAAGUAUAAC

UACAAUAUAACUACAAUAUAAUUUAUGGCAAACUCAAACAUUUUGAGCAUUCAUAGAUCUAUGAAAUUUG

UAAAGAAUCCUAUGUAAACAGCUUUAUGAUAUUCAUGGCUAUUUAUUUAUUUUCAUGAAGCAAUUCUUGA

UUGUUUUCCUCAAGAAGAUAAUAACAUAAUAAACCACAGAUAUUUUUAAAAAAUUGGUGGCCUUCAUACA

UAGGUCCUAAACCCAGGCCAAUUCCCUGGCCAUCCUAAUUUAGUUGGCCCUUCUUUCAGCACUUCUAUUA

ACAUUUCUCUGAAAUAGCUAUUUAGAACUGCUUUAUUUACAUAUGCAUUUUAUUUUCACUCUUUUUAAUA

AAGCUAUCAAAACUCUAUAAAAUCAUGCUAAGUAUUUUGGGUUGUGAUGUUCAACAAUCAGCAUUUAAAA

ACAGCUCACAAGUCACCCAAAUCUUUUGCAAACUAGGUAACUAUCAAAAAGCUAAAAUUAGGUUCUCUAA

UUUUCAUCCGAAAGAUUUGUGUUCAAACCUGUUUGGGGCAUGGUGGCUCAUGCCUGUAACCCCAGCAUGU

UGGCAGGUCAUGACAGUAGGAACACUUGAAGCCAGGAGUUUGAGACUAGCCUGGGCAACAUAGCAAGACC

CCUUAUCUACAAAAAUUUAAAUAUUAGCCAGGCAUGGUGGCAUGUACCUGUAGUCUUAGCUACUUGGGAG

GCUGAGGCAGGAGGGUUGCUUGAGCCCAGAGUUGAGGCUGCAGAGAGCUAUGAUCAUGCCAUUGCACUCU

AGCCUGGGUGACAGAGCGAGACCUGGUCACUUAAAAAAGUUUUUAGAAAACCUGUUUGCUUCCAUUUUAU

UCUAAGUUAAGUUCUUCAGUGUAACUGCCUUUCUGUAUUGUUGGGUGUAAUAAGUUCAGCGAUUAUAAAA

UUUAAAUAUUAAUAUGACAGUGCCUUCUGAAGGGUGAAACCAUCAGUACAAACAGUAAUCUACAUGGAAA

GAGAGGUCUAAUUUUACUUCAAGCUUAUACUUAAUAAGCUCUUUCUUCCAAAUAUUAUUUUUAAUUGAUA

AAAAGUCACAAGUAGACAUUCCUGAAACAAACGUAAAUAUAUAUAAAACUUAACCAUGUUAUUUUAAAAA

AAAACAUAGUUCAUGAAAUAGGAAAAAGAACAACUUUAUAUAUAUUUUUGAAAUGCUAAGAAGAAAUUGU

GUUGUUAACAAACCAGUUGCCCAUAUUUUUUAUUUUACAUAAAAACAAGGCAAUGUAAAAACAUUAAUAG

AAAAUUACACACGAACCUGUCAAACAUCUUGUCUUACUACAUUAUGUAAGUAUUCAUAAUGCAGUUAUAU

UUGUGAGUUUGAAAUAACGGUAGAUUGAAUUCAAAUUUAAGGUGAUGUUAAAUUCUUAAUUGAAUGUAUU

UAAAAAUCUGAUAAAUGUAAUAUAUUUUGUAUAGGUCCCUACUUAAAUUAUCAAAACCUAUUUCCAACAG

GCUUGGUAGGUAUGUGAUAAAAUGAUCUAUGUAGUCUCGGAAAACACUGCAUGGUGUCUUUCAUAUUAAA

UUAAAAAGUGGUUCAAAUAGCCUAAGAUGAAUGAACCUAAGAUGGUAUAAAGAAUCUUUAGCCCUAGAUU

GAGUUUUAUACGUAGAUUAGGACAAAUGUCUCAAAGUAAUAACGGAUGUUGUAAAAUAUAUCACAAUUUA

AAAACAUUCUAGACUUCUGAUCUCAUUCUUUAACCAUAAAUCUUUGUUUCUAUAGGUACGUUUAAAUCCU

CUUUCUUUUUAAAUUGCCAGAACAACAAAAAAUAUGUGCUUUAAACAUUUAUUAUAUAAAUGUAAUUUAU

UAUUUUUUAAAUAUGGAAAGCAAAUUAGUGAAAGUUGUUUUAUAUAUUUGCUUCAAAACCUCCCACAAAA

AUCUUCUAAGUAAAACUACAUUCUACCUGUGUAGCUCAAUUUUUGCCUGUGCAUGAAUAACUUUAUAGAA

GAAAGAUCUCAUAUUCCUGAAAUAAACUCACGAAAAAAAGCAUUAUGGUUAUUUCUUUUCAAAUUACUAU

UAAUAGGUGUUUUCAAAAAACUAGAUGUCUACAGCUAAUGCAAAAUGAAUAUGUGCUUGAUAAAUUAGAA

GCCCAUGGUACUGUGUUGAUUGAGGCAAAAUAUAUUUCACAUCAUAGAAUUUUAAGGAGAAGGUGACAUC

UUCCUCAUUGUAUACAUUGAAGUAUAUCCAAAAAAGAUUACUUCCAUAAUUUAGGAAAGUAAGUUGGUGG

CAAGAGAGCAAGUUGGCAAGAAUCCCUAUUUCAAUGCUUUUUUAUUCAUACUAAACACAUAUCUGUGUAA

AGUCUGUCAUAUUACAUGAUUUGAAAGCUUGCCAAACACGGGAUUGUAUACAAGUGAUGCAAUAAAUACU

-continued

GUGCCCAAGUUAUUAUCUGCUCAAGUAUGUACCGUGGUCAAACAACUAACUGCAUAUCAGGAAGGAUUUC

AUCAACUUUGCUUACAGCGAAAGGAUGACUAAACAAUACUGCAUAAGAAAGCAGGAAAAUUUGACAAAAG

AGUUUAAGAGACUAUUAUCAGUAUUUUGGGCAGCACAGUCAAAUGUUAGGCUAUGUAAAUAAUAGCAAAU

AGAACUUCUGUCAAUAACUUUUUUCUCAGUUAUCUUUGUUUUUUUUGAGGAGUGUAAUAUGUACUUAGAA

UAAUUUUUCAAGUUCUGUGGUUAUUCUAUGAACAAAAAGGGAUAUGAAAGAAGAAAGGCUAUGAAACACA

AUACUCUAAAGGUAAGUCUUAUCCUUGUUGGCAUGUGAGUCAAGAUGAAUGAAAAACAUUUGUAGAAAUG

AAUAGCCUACAUAUAUUUUUAAUCCCAUGGCAUUUUAUAGGCACAUAUAAAUUGGUUCUGAUGCAAUGUA

GAAUAAAUUUAAGCACCUCAAAAUAUAGAAUAACCUCUGUACAUUGAUAAAAAGUCAAGCUCCCUAAUAA

UGCAUUUUAACUAAACAUUCAUAACUAAUGUCCAUUACUUCUAUCAAGCAUUUCAUUGCAAAGCCAAGGC

AAAUACUUUUGUUGAUUUCCAAAUAAUAGAUAAAUAAUAGAUUUUUCUGUAUGCGUGUGUUGUUUAUUUA

CAUGGGAAACAAGACUAAUUACAAUCCUGUGAAAAGAUGACAAGGCAGAUGUAAAAGUUUUCUACAUGGU

CUUCUGAUUUAUUAAAAACCAAAAAACUGAAUCACUUUUGUAUGCUAUAAUCAAUAAUUCCUACAGAGUU

CUCUUACGAUUCUUAAAGAAUCAUCAGUGCAAAAAUAACCAUCUGCUAAUGCUGCCCACCUUUCUUAGGA

AAUCAGAGUUAGUGACUGCACUGCCUUCGAGAAUAUUUUGAUAAAAAGGAUUUUGGCAUAGACUUCCUCA

AAAGAGUUUUAUUAACACAAAUAAAUCACUUUCACAGGCUGUAAACAAUAUAUCAAAAAUGAAGCUCUAU

UUUUUGCUUUCCUUGCUGUCUUUCCCUUUGUCUUCCUUUUCUGUUCUGUCUUGUUCAUAUUUCUCUUUGU

CUGGCUUUGUUACACUAUCAUAUGAAGGUGGAGAGGUGGUGGAUGAAGUGGCAUCUGUUUUUUCUGGACU

UGAGUUCUCAUUAACAUUAUCAAAAGCCAUAUCUUUUUUAUUGAGUAAAUCAUCAUCUCUGUCUCCAUCU

UUUAUGUAUAUACUUGAUAUAUUUUUGACAUUUUGCCUUAAGCGGUAACGUCUAUAAGCACGCUGAAUGA

CAGUAGCAGACACAUCCUCUUGUUUCCGUUUUAGUGUGGUUGUGAUGGGUUCAUAGGACACUUUGGAAGG

AUUUGCAGACAUGAACCUUUCUUCCAUCUGUGAACGAAGAGAAUCCAUCUCCCCACUCUCACCCAAAACA

CGCUUUGUAAAAGCAAAUAAGAUGUCAAGACAAUGGAUCCGGUCACCACUAACCAUGGGCAGAUCCAUGG

CAAUGAGCUGGACUUUGUUGGGUUUUGCUAUGAGAAGAGGAGGAUCCAGGGCAGCUGCAAAAUCAGAGAG

UUUAGAGAACUCUAUAAACUGGGUCGCAUCGGGAUCAAACUUCUCCCAAACCUCAUAGAACAUCUCAAAG

UCAUCCUCACUCAGAGGUUCAGUACUUUCUUCAGUGGCAACACUAAAAUUCUCCAGUAUGACUGCAAUGU

ACAUGUUCACCACAACCAGGAAGGAUAUGAUGAUAUAACUAACAAAGUAGAAUAUUCCAACAGAUGGGUU

ACCACAGUCUCCUUCAACUGAACUUCCAGGAUGAACUUUUUUUGGGUCACAGUCGGGUGGCUUACUGUUA

AGAAUAGGUGCUAGCAAUCCAUCCCAGCCAGCAGAGGUUGUAAUUUGGAACAGGCAAAUCAUACUGUUGC

CAAAGGUCUCAAAAUUGAACAUGUCAUUAAUUCCAUCUUCCUUUUUAACAUAGGCAAAGUUGGACAUUCC

AAAGAUGGCGUAGAUGAACAUGACCAGGAAGAGCAGGAGGCCGAUGUUAAACAACGCAGGAAGGGACAUC

AUCAAAGCAAAGAGCAGCGUGCGGAUCCCCUUUGCUCCUUUGACUAGACGUAGGAUUCGGCCAAUCCUGG

CAAGACGGAUCACUCGGAACAGGGUAGGGGACACAAAAUACGUUUCAAUCAAAUCAGCUAGAAACAUACC

UACAAUGGAGAUAAUCACAACCACAAAAUCAAAAAUAUUCCAUCCUACAGUGAAGUAGUAGUGUCUGAGG

GAGAUCAGUUUUAGCACACAUUCUCCAGUGAAAAGGAUUAUAAAAACCACAUUUAUCCAAUAUAAAACUU

CAGUCAUAUGUUGACUUUGACCCUCCUUUUCUACCAUCAUGGUUACCAUGUUGAGACAGAUAAGAACCAU

GAUACUAAUAUCAAAGGCUUGAUUUGUCACUAGGUCAAAUAUACAUCCUUGGAUUUUGUUCCCUGGUCGA

GGAAUUGGCUUUUGUGGCUUCUUGGACCCCAGCUUUUUCAUUGCAUUAUAGUAUUUCUUCUGUUCUUCUG

UCAUAAAGAUGUCUUGACCUCCAAGCUUCUUUUUCUGUUGGUUGAAAUUAUCUAUGAUGACACCAAUGAA

CAAGUUCAAAGUGAAGAAUGACCCAAAGAUGAUAAAGACGACAAAAUAAAUAUACAUGUAGAGGCUAUAU

UCAUAUUUGGGCUGCUUGUCUACAUUAACAGAAUCCACUGCUGCAUACAUAAUAAUCGUCCAUCCCUUAA

-continued

AAGUUGCAACUUGAAGCAGAGAUAGGUAACCAAGUCCGACAUUAUCAAAGUUCACUUUCAGGUUUUUCCA

UCGCACAUUUUGACUAACAUUCAUAAGGGCAAAACAUUCGGAACGAUUUGGAACUUGACUUGCAGGAAAC

CGUGACCCAUCUGUGGUGUUAAUACACUCAUAGAACUUGCCAGCAAACAAAUUUACUCCCAUGAUGCUGA

AUAUCAGCCAGAAUAUAAGACACACAAGUAGCACAUUCAUGAUGGAAGGAAUUGCUCCUAUGAGUGCAUU

CACAACGACCCUCAUUCCUUCAAAUCUAGAUAAGGCUCUUAGAGGUCUUAAAGCUCUCAGUGUCCGAAGG

GAUUUAAUGGGGCCAAGAUCUGAGUAGCCAAGAGUGUUUGCCACUAAAGUAACCAAAGAAACAUCAACAA

UUAGGAAAUCCAGCCAACACCAGGCAUUGGUGAAAUAUGUUUUAUAACCAUAUGCUAUCCAUUUUAGAAG

CAUUUCCAGAAUGAAGAUGUAAGUGAAGAUCUUGUCUGCAUACUCCAGGAUAAUCUUAAUGGUCUUUUUC

CUUUCAAUAUAAAUAUCUUCAAAAGCCAGGGCACCACUGCUGAGCAGGAUCAUGAGGACAAUGAAGCUUU

CAAACCAACUGUGUUCAACAAUCUUGUAGCAGGUUUUCCUGAUGUUCCACCAGAUUUUUCCUUUCCCUGA

CUCUAUGUUAACUUGGCAGCAUGAGAACCUCCGUACACAACCAUCUGUGAAACAGGCCUCUGGCUCAUCG

GAAUUCAUAGGUUCAGCCUCUGCUUCUUCUCCUUCUCCAGGCAAAGGGUUAUCAACUGUGCUGCACUCUG

AGGAGCUUGACCGGUUUAAUCUCACUUUGCUGUAUUCACUAUCCGAAUCACUGCUAAGUUCCUCAGCAUU

CAUAUUUUCCAAAUCGGAUUCCCCAGGUGCAAUUGGCACUGUCACUGUGAGGCUGGGAUUGUGAAUAAAU

GAUUGACCAUCACUGUCUUCCAUCAAGUGUUUGUCCACGCUGCUUCCAAAACCACUGAUUUUAUCUUUUU

CCUUGAGGAAAUUGUGACCUUUGCUCAUUUCAGCAAGUGUAUGGUUAGAAAUAUAGUUUUCCUUCUUAGU

AUUCAGAUCUUCUGCUUGUCUUAUCUCCCUGGAAAUCUUUGGCUUUUUGGAAAAUGCUUUUAGAAUAAAU

UCACGUAAGGUUUGUUUCACAUAAUUUAUUCCCUUUUUAAUUCUAGUCACUGCAAUCUGGAGGUUGUUUG

CAUCAGGGUCUUCUUCAAUUGCUGUAAGAUUGUCUGAACUAAAUGAGCUCAAUAAUAAGGCCAGAAAUAG

GUUUAGGACCACCAGGUUUCCAAUGACCAUGACCAUCAUGUAAACAAUAAGGCACAUAGCUUGACCAGCG

ACCUCCAUACAGUCCCACAUGGUCUCUAUCCACUCUCCACACAGCACGCGGAACACAAUCAGGAAGGAGU

GGAAGAAGUCGUUCAUGUGCCACCGUGGGAGCGUACAGUCAUCAUUGAUCUUGCAGACACAUUCUUUGUA

GCUCUUACCAAAGAGCUGCAUGCCGACCACAGCAAAAAUGAAGACGAUGAUGGCCAACACUAAGGUGAGG

UUACCUAGAGCCCCUACUGAGUUACCAAUGAUCUUAAUCAGCAUGUUCAAUGUUGGCCAGGAUUUUGCCA

ACUUGAAGACUCGGAGCAGUCUGAAUGAUCGCAGAACUGACAAUCCUUCCACAUCUGCUAGAAAGAGCUC

CACUAAACUUAAAGUCACAAUAAGGCUGUCAAAAAUAUUCCAGCCUACUUGGAAAUACUCAUAUGGAUCC

AUGGCAAUCAGUUUUAAUACCAUUUCAGCUGCAAAGAUUCCAGUAAAGACCAAAUUUCCUAUAGCAAGUA

CAUUUUUGAAUUCCUCAGUCAUUGGGUGGUGUUCCAUAGCCAUAAAUAAUGUGUUUAAAACUAUGCAAAU

GGUAAUUGCAAGAUCUACAAAAGGAUCCAUUACAAUAAAAUAGAUACACUUUUUGAAUUUUAUCCAAUAU

GGAGAGCAAUUCCAGAUCAAGAAUUUGUGUGCAAAUCUGUACCACCAAGGUGGACAUUUUUGUCUGGACU

CUUCAAGUUCUUCCACAGUGUUUGUUAAUAUGCUUGCUCUACUCAUUGCUCUCUGUCUGAGGUUGGGAUC

AUUCAGCAUAUCCUCUGAAAGGAGAUAGGAACUACAACGCCUUUUCUUGUGUAUUUGAUUGGUCGUGCCC

UCUGGCAGAAGCUGUCCAUUGGGGAGCAUGAGGGCUGAGCGUCCAUCAACCAGGGAGACCACACCGUUGC

AGUCCACAGCACUGUGCAUUUUCCCGUUCACCGGCAGCAUUGGUGGGGACCUACUGGCUUGGCUGAUGUU

ACUGCUGCGUCGCUCCUGGGGUCUGUGGGGCACAAACAGUGAGCCCCUUCUGCUCUCAUUGUCUCCAAAA

AUGCUGUGCUCAUCAUCGGCAAAUUCAGUCUCAGAUCCUAUAUCUCUUCCUCUGCCUUUGAAACUAAAAA

GACUUGUUCUGCUGCUUCGCCUUGCAGAAAACAAGGAGCCACGAAUGCUGAGUGGUGACUGAUUGGGGGU

AGACAACCUCUUUUCAUGUGCUCGCCUAUGCCCUUCGACACCAAGGUGGAAACUUUUUCUUCUGAUGCUG

UCCUCUGAUUCUGAUUUCGACAAUUUCUCAGCAUCUCCCUUUUCCUCUCCACUGGAGAGCUUCUUUUGAU

UCUUUUUCUUUCUUCUGUUUCUUCUUUCUUUAGCACUUUUAGAGCUCAGUUUGGAUGUUUCAGAAGAACU

CUCUGAGAGGCCCAUAAUUCUGCUUCUCCUAAUACUUGUAUAUUCAGCCGCUGCCGCUGCAAUUGCCUCA

-continued

GCUUCUUCUUGCUCUUUUUUAAGACGGUCUAACAUCUGUUGAAAUUCUAAUUCUUUCUGUUUAGCUUCUU

CAAUGUUUGCCUGGUUCUGUUCUUCAUAUGCCAUGGCAACCACAGCCAGGAUCAAGUUUAUUAGAUAAAA

GGAGCCCAGGAAAAUCACUACGACAAAGAAGAUCAUGUAGGUUUUGCCAGCAGCACGCAGCGUCUGUUGG

UAAAGGUUUUCCCAGUAAUCUUGGGUCAUUAGCCUAAACAAGGCUAAGAAGGCCCAGCUGAAAGUGUCAA

AGCUCGUGUAGCCAUAAUCAGGGUUUCUGCCAAUUUUCACACAGGUGUACCCCUCUGGACACUGACCUGA

AUCUGUGCUGAAACCACAAAGGAGAGCAUCUUUGGAUCCUUCCAAGUAAUAAAAAUAUUUUCUAAAGUCU

UCUUCACUCUCUAGGGUAUUCAUUAUGCUUUCUAAUGUUUCAUUAUUUUCAAGUGAAUUUCGAAAACAUU

UAUGCUUCAGGUUUCCCAUGAACAGCUGUAGUCCAAUUAGUGCAAACACACUCAGACAGAACACAGUCAG

GAUCAUGACAUCAGAAAGCUUCUUCACUGACUGGAUCAAAGCCCCUACAAUUGUCUUCAGGCCUGGGAUU

ACAGAAAUAGUUUUCAAAGCUCUCAAUACUCUGAAAGUUCGAAGAGCUGAAACAUUGCCUAGGUUUACAA

AUUCUGUUAAAUACGCAAAAACAAUGACGACAAAAUCCAGCCAGUUCCACGGGUCACGAAGAAAAGUGAA

UUCUCCUACACAGAAGCCUCUUGCAAGGAUUUUUACAAGUGAUUCAAAAGUAUAUAUUCCAGUAAAAGUG

UACUCGACAUUUUUGGUCCAGUCCGGUGGGUUAUUCAUGGUCAUAAAUAUGCAGUUUGUCAGAAUAGUGC

ACAUGAUGAGCAUGCUGAAUAAGGAGUGUACUAAAAUCUUAAUAGAUAUUCUUCUUAGAGGACUGAAAGG

AGAAAGCAUAUAUAAAGCAGGUGUGGCAUUGAAACGGAAGAUUGUUUUCCCUUUGUUCAAUACUAUGAAA

GUCUUUUUGUCUGCAUAGUAGGGGUCCAAGUCCUCCAGGGGCUCUGACACCAUGCCGGGAGGAAUGUCCC

CAUAGAUGAAGGGCAGCUGUUUGCCAGCUUCCAAGUCACUGCUUGGCUUUGGGGCUUCUUCAUCAUCAUC

UUUCUUUUCUUCUUUGGGUUCCUUUGAUUUUCUUUCAGCAAUGCGUUGUUCAAUGAGGGCAAGAGACUGU

UUUGUGAAAUGGACAAAGCUCUGAGGUCCUGGGGGAGGCAACAUUGCCAUCUUUUCAUCCUGUAUAUUUU

AAUUCCUCUUCAGCUCCUCACAUAAGAGGCUUGCAACCUAGCCCGCCGAUCAUCCCCACCCAGUGCACCU

GCAGAAUCUGGCUCCAGGAGAGGGCGCGGGCCUCUCCUUCCCCGGCGCUCUCUCAGGGCUGCUUCUUUUU

CUCUGGGCUCCUGUUGCUCAGGGGACGCCUGCCGCUAGCAGCCACUGGCACCCAGGCUAGCCCAGCCUCA

GCCGAGCUGGCGGAAUUGGAAAGCCGACAGCCGCCGCUGGAGCGCUGGCGACCGCCUGCAAGCAGACUGC

GCCCCUCCUGCCAGGGCGCGCCCGUGGAGGUAGCAGCCCCG

A human SCN9A mRNA may have the sequence of SEQ ID NO: 4001 provided herein.

*Homo sapiens* Sodium Channel, Voltage Gated, Type IX Alpha Subunit (SCN9A), Transcript Variant 2, mRNA (SEQ ID NO: 4001)

AGTCTGCTTGCAGGCGGTCGCCAGCGCTCCAGCGGCGGCTGTCGGCTTTCCAATTCCGCCAGCTCGGCTG

AGGCTGGGCTAGCCTGGGTGCCAGTGGCTGCTAGCGGCAGGCGTCCCCTGAGCAACAGGAGCCCAGAGAA

AAAGAAGCAGCCCTGAGAGAGCGCCGGGGAAGGAGAGGCCCGCGCCCTCTCCTGGAGCCAGATTCTGCAG

GTGCACTGGGTGGGGATGATCGGCGGGCTAGGTTGCAAGCCTCTTATGTGAGGAGCTGAAGAGGAATTAA

AATATACAGGATGAAAAGATGGCAATGTTGCCTCCCCCAGGACCTCAGAGCTTTGTCCATTTCACAAAAC

AGTCTCTTGCCCTCATTGAACAACGCATTGCTGAAAGAAAATCAAAGGAACCCAAAGAAGAAAAGAAAGA

TGATGATGAAGAAGCCCCAAAGCCAAGCAGTGACTTGGAAGCTGGCAAACAGCTGCCCTTCATCTATGGG

GACATTCCTCCCGGCATGGTGTCAGAGCCCCTGGAGGACTTGGACCCCTACTATGCAGACAAAAAGACTT

TCATAGTATTGAACAAAGGGAAAACAATCTTCCGTTTCAATGCCACACCTGCTTTATATATGCTTTCTCC

TTTCAGTCCTCTAAGAAGAATATCTATTAAGATTTTAGTACACTCCTTATTCAGCATGCTCATCATGTGC

ACTATTCTGACAAACTGCATATTTATGACCATGAATAACCCACCGGACTGGACCAAAAATGTCGAGTACA

CTTTTACTGGAATATATACTTTTGAATCACTTGTAAAAATCCTTGCAAGAGGCTTCTGTGTAGGAGAATT

-continued

CACTTTTCTTCGTGACCCGTGGAACTGGCTGGATTTTGTCGTCATTGTTTTTGCGTATTTAACAGAATTT

GTAAACCTAGGCAATGTTTCAGCTCTTCGAACTTTCAGAGTATTGAGAGCTTTGAAAACTATTTCTGTAA

TCCCAGGCCTGAAGACAATTGTAGGGGCTTTGATCCAGTCAGTGAAGAAGCTTTCTGATGTCATGATCCT

GACTGTGTTCTGTCTGAGTGTGTTTGCACTAATTGGACTACAGCTGTTCATGGGAAACCTGAAGCATAAA

TGTTTTCGAAATTCACTTGAAAATAATGAAACATTAGAAAGCATAATGAATACCCTAGAGAGTGAAGAAG

ACTTTAGAAAATATTTTTATTACTTGGAAGGATCCAAAGATGCTCTCCTTTGTGGTTTCAGCACAGATTC

AGGTCAGTGTCCAGAGGGGTACACCTGTGTGAAAATTGGCAGAAACCCTGATTATGGCTACACGAGCTTT

GACACTTTCAGCTGGGCCTTCTTAGCCTTGTTTAGGCTAATGACCCAAGATTACTGGGAAAACCTTTACC

AACAGACGCTGCGTGCTGCTGGCAAAACCTACATGATCTTCTTTGTCGTAGTGATTTTCCTGGGCTCCTT

TTATCTAATAAACTTGATCCTGGCTGTGGTTGCCATGGCATATGAAGAACAGAACCAGGCAAACATTGAA

GAAGCTAAACAGAAAGAATTAGAATTTCAACAGATGTTAGACCGTCTTAAAAAAGAGCAAGAAGAAGCTG

AGGCAATTGCAGCGGCAGCGGCTGAATATACAAGTATTAGGAGAAGCAGAATTATGGGCCTCTCAGAGAG

TTCTTCTGAAACATCCAAACTGAGCTCTAAAAGTGCTAAAGAAAGAAGAAACAGAAGAAAGAAAAAGAAT

CAAAAGAAGCTCTCCAGTGGAGAGGAAAAGGGAGATGCTGAGAAATTGTCGAAATCAGAATCAGAGGACA

GCATCAGAAGAAAAAGTTTCCACCTTGGTGTCGAAGGGCATAGGCGAGCACATGAAAAGAGGTTGTCTAC

CCCCAATCAGTCACCACTCAGCATTCGTGGCTCCTTGTTTTCTGCAAGGCGAAGCAGCAGAACAAGTCTT

TTTAGTTTCAAAGGCAGAGGAAGAGATATAGGATCTGAGACTGAATTTGCCGATGATGAGCACAGCATTT

TTGGAGACAATGAGAGCAGAAGGGGCTCACTGTTTGTGCCCCACAGACCCCAGGAGCGACGCAGCAGTAA

CATCAGCCAAGCCAGTAGGTCCCCACCAATGCTGCCGGTGAACGGGAAAATGCACAGTGCTGTGGACTGC

AACGGTGTGGTCTCCCTGGTTGATGGACGCTCAGCCCTCATGCTCCCCAATGGACAGCTTCTGCCAGAGG

TGATAATAGATAAGGCAACTTCTGATGACAGCGGCACGACCAATCAAATACACAAGAAAAGGCGTTGTAG

TTCCTATCTCCTTTCAGAGGATATGCTGAATGATCCCAACCTCAGACAGAGAGCAATGAGTAGAGCAAGC

ATATTAACAAACACTGTGGAAGAACTTGAAGAGTCCAGACAAAAATGTCCACCTTGGTGGTACAGATTTG

CACACAAATTCTTGATCTGGAATTGCTCTCCATATTGGATAAAATTCAAAAAGTGTATCTATTTTATTGT

AATGGATCCTTTTGTAGATCTTGCAATTACCATTTGCATAGTTTTAAACACATTATTTATGGCTATGGAA

CACCACCCAATGACTGAGGAATTCAAAAATGTACTTGCTATAGGAAATTTGGTCTTTACTGGAATCTTTG

CAGCTGAAATGGTATTAAAACTGATTGCCATGGATCCATATGAGTATTTCCAAGTAGGCTGGAATATTTT

TGACAGCCTTATTGTGACTTTAAGTTTAGTGGAGCTCTTTCTAGCAGATGTGGAAGGATTGTCAGTTCTG

CGATCATTCAGACTGCTCCGAGTCTTCAAGTTGGCAAAATCCTGGCCAACATTGAACATGCTGATTAAGA

TCATTGGTAACTCAGTAGGGGCTCTAGGTAACCTCACCTTAGTGTTGGCCATCATCGTCTTCATTTTTGC

TGTGGTCGGCATGCAGCTCTTTGGTAAGAGCTACAAAGAATGTGTCTGCAAGATCAATGATGACTGTACG

CTCCCACGGTGGCACATGAACGACTTCTTCCACTCCTTCCTGATTGTGTTCCGCGTGCTGTGTGGAGAGT

GGATAGAGACCATGTGGGACTGTATGGAGGTCGCTGGTCAAGCTATGTGCCTTATTGTTTACATGATGGT

CATGGTCATTGGAAACCTGGTGGTCCTAAACCTATTTCTGGCCTTATTATTGAGCTCATTTAGTTCAGAC

AATCTTACAGCAATTGAAGAAGACCCTGATGCAAACAACCTCCAGATTGCAGTGACTAGAATTAAAAAGG

GAATAAATTATGTGAAACAAACCTTACGTGAATTTATTCTAAAAGCATTTTCCAAAAAGCCAAAGATTTC

CAGGGAGATAAGACAAGCAGAAGATCTGAATACTAAGAAGGAAAACTATATTTCTAACCATACACTTGCT

GAAATGAGCAAAGGTCACAATTTCCTCAAGGAAAAAGATAAAATCAGTGGTTTTGGAAGCAGCGTGGACA

AACACTTGATGGAAGACAGTGATGGTCAATCATTTATTCACAATCCCAGCCTCACAGTGACAGTGCCAAT

TGCACCTGGGGAATCCGATTTGGAAAATATGAATGCTGAGGAACTTAGCAGTGATTCGGATAGTGAATAC

-continued

AGCAAAGTGAGATTAAACCGGTCAAGCTCCTCAGAGTGCAGCACAGTTGATAACCCTTTGCCTGGAGAAG

GAGAAGAAGCAGAGGCTGAACCTATGAATTCCGATGAGCCAGAGGCCTGTTTCACAGATGGTTGTGTATG

GAGGTTCTCATGCTGCCAAGTTAACATAGAGTCAGGGAAAGGAAAAATCTGGTGGAACATCAGGAAAACC

TGCTACAAGATTGTTGAACACAGTTGGTTTGAAAGCTTCATTGTCCTCATGATCCTGCTCAGCAGTGGTG

CCCTGGCTTTTGAAGATATTTATATTGAAAGGAAAAAGACCATTAAGATTATCCTGGAGTATGCAGACAA

GATCTTCACTTACATCTTCATTCTGGAAATGCTTCTAAAATGGATAGCATATGGTTATAAAACATATTTC

ACCAATGCCTGGTGTTGGCTGGATTTCCTAATTGTTGATGTTTCTTTGGTTACTTTAGTGGCAAACACTC

TTGGCTACTCAGATCTTGGCCCCATTAAATCCCTTCGGACACTGAGAGCTTTAAGACCTCTAAGAGCCTT

ATCTAGATTTGAAGGAATGAGGGTCGTTGTGAATGCACTCATAGGAGCAATTCCTTCCATCATGAATGTG

CTACTTGTGTGTCTTATATTCTGGCTGATATTCAGCATCATGGGAGTAAATTTGTTTGCTGGCAAGTTCT

ATGAGTGTATTAACACCACAGATGGGTCACGGTTTCCTGCAAGTCAAGTTCCAAATCGTTCCGAATGTTT

TGCCCTTATGAATGTTAGTCAAAATGTGCGATGGAAAAACCTGAAAGTGAACTTTGATAATGTCGGACTT

GGTTACCTATCTCTGCTTCAAGTTGCAACTTTTAAGGGATGGACGATTATTATGTATGCAGCAGTGGATT

CTGTTAATGTAGACAAGCAGCCCAAATATGAATATAGCCTCTACATGTATATTTATTTTGTCGTCTTTAT

CATCTTTGGGTCATTCTTCACTTTGAACTTGTTCATTGGTGTCATCATAGATAATTTCAACCAACAGAAA

AAGAAGCTTGGAGGTCAAGACATCTTTATGACAGAAGAACAGAAGAAATACTATAATGCAATGAAAAAGC

TGGGGTCCAAGAAGCCACAAAAGCCAATTCCTCGACCAGGGAACAAAATCCAAGGATGTATATTTGACCT

AGTGACAAATCAAGCCTTTGATATTAGTATCATGGTTCTTATCTGTCTCAACATGGTAACCATGATGGTA

GAAAAGGAGGGTCAAAGTCAACATATGACTGAAGTTTTATATTGGATAAATGTGGTTTTTATAATCCTTT

TCACTGGAGAATGTGTGCTAAAACTGATCTCCCTCAGACACTACTACTTCACTGTAGGATGGAATATTTT

TGATTTTGTGGTTGTGATTATCTCCATTGTAGGTATGTTTCTAGCTGATTTGATTGAAACGTATTTTGTG

TCCCCTACCCTGTTCCGAGTGATCCGTCTTGCCAGGATTGGCCGAATCCTACGTCTAGTCAAAGGAGCAA

AGGGGATCCGCACGCTGCTCTTTGCTTTGATGATGTCCCTTCCTGCGTTGTTTAACATCGGCCTCCTGCT

CTTCCTGGTCATGTTCATCTACGCCATCTTTGGAATGTCCAACTTTGCCTATGTTAAAAAGGAAGATGGA

ATTAATGACATGTTCAATTTTGAGACCTTTGGCAACAGTATGATTTGCCTGTTCCAAATTACAACCTCTG

CTGGCTGGGATGGATTGCTAGCACCTATTCTTAACAGTAAGCCACCCGACTGTGACCCAAAAAAAGTTCA

TCCTGGAAGTTCAGTTGAAGGAGACTGTGGTAACCCATCTGTTGGAATATTCTACTTTGTTAGTTATATC

ATCATATCCTTCCTGGTTGTGGTGAACATGTACATTGCAGTCATACTGGAGAATTTTAGTGTTGCCACTG

AAGAAAGTACTGAACCTCTGAGTGAGGATGACTTTGAGATGTTCTATGAGGTTTGGGAGAAGTTTGATCC

CGATGCGACCCAGTTTATAGAGTTCTCTAAACTCTCTGATTTTGCAGCTGCCCTGGATCCTCCTCTTCTC

ATAGCAAAACCCAACAAAGTCCAGCTCATTGCCATGGATCTGCCCATGGTTAGTGGTGACCGGATCCATT

GTCTTGACATCTTATTTGCTTTTACAAAGCGTGTTTTGGGTGAGAGTGGGGAGATGGATTCTCTTCGTTC

ACAGATGGAAGAAAGGTTCATGTCTGCAAATCCTTCCAAAGTGTCCTATGAACCCATCACAACCACACTA

AAACGGAAACAAGAGGATGTGTCTGCTACTGTCATTCAGCGTGCTTATAGACGTTACCGCTTAAGGCAAA

ATGTCAAAAATATATCAAGTATATACATAAAAGATGGAGACAGAGATGATGATTTACTCAATAAAAAAGA

TATGGCTTTTGATAATGTTAATGAGAACTCAAGTCCAGAAAAAACAGATGCCACTTCATCCACCACCTCT

CCACCTTCATATGATAGTGTAACAAAGCCAGACAAAGAGAAATATGAACAAGACAGAACAGAAAAGGAAG

ACAAAGGGAAAGACAGCAAGGAAAGCAAAAAATAGAGCTTCATTTTTGATATATTGTTTACAGCCTGTGA

AAGTGATTTATTTGTGTTAATAAAACTCTTTTGAGGAAGTCTATGCCAAAATCCTTTTTATCAAAATATT

CTCGAAGGCAGTGCAGTCACTAACTCTGATTTCCTAAGAAAGGTGGGCAGCATTAGCAGATGGTTATTTT

TGCACTGATGATTCTTTAAGAATCGTAAGAGAACTCTGTAGGAATTATTGATTATAGCATACAAAAGTGA

-continued

TTCAGTTTTTTGGTTTTTAATAAATCAGAAGACCATGTAGAAAACTTTTACATCTGCCTTGTCATCTTTT

CACAGGATTGTAATTAGTCTTGTTTCCCATGTAAATAAACAACACACGCATACAGAAAAATCTATTATTT

ATCTATTATTTGGAAATCAACAAAAGTATTTGCCTTGGCTTTGCAATGAAATGCTTGATAGAAGTAATGG

ACATTAGTTATGAATGTTTAGTTAAAATGCATTATTAGGGAGCTTGACTTTTTATCAATGTACAGAGGTT

ATTCTATATTTTGAGGTGCTTAAATTTATTCTACATTGCATCAGAACCAATTTATATGTGCCTATAAAAT

GCCATGGGATTAAAAATATATGTAGGCTATTCATTTCTACAAATGTTTTTCATTCATCTTGACTCACATG

CCAACAAGGATAAGACTTACCTTTAGAGTATTGTGTTTCATAGCCTTTCTTCTTTCATATCCCTTTTTGT

TCATAGAATAACCACAGAACTTGAAAAATTATTCTAAGTACATATTACACTCCTCAAAAAAAACAAAGAT

AACTGAGAAAAAAGTTATTGACAGAAGTTCTATTTGCTATTATTTACATAGCCTAACATTTGACTGTGCT

GCCCAAAATACTGATAATAGTCTCTTAAACTCTTTTGTCAAATTTTCCTGCTTTCTTATGCAGTATTGTT

TAGTCATCCTTTCGCTGTAAGCAAAGTTGATGAAATCCTTCCTGATATGCAGTTAGTTGTTTGACCACGG

TACATACTTGAGCAGATAATAACTTGGGCACAGTATTTATTGCATCACTTGTATACAATCCCGTGTTTGG

CAAGCTTTCAAATCATGTAATATGACAGACTTTACACAGATATGTGTTTAGTATGAATAAAAAAGCATTG

AAATAGGGATTCTTGCCAACTTGCTCTCTTGCCACCAACTTACTTTCCTAAATTATGGAAGTAATCTTTT

TTGGATATACTTCAATGTATACAATGAGGAAGATGTCACCTTCTCCTTAAAATTCTATGATGTGAAATAT

ATTTTGCCTCAATCAACACAGTACCATGGGCTTCTAATTTATCAAGCACATATTCATTTTGCATTAGCTG

TAGACATCTAGTTTTTTGAAAACACCTATTAATAGTAATTTGAAAAGAAATAACCATAATGCTTTTTTTC

GTGAGTTTATTTCAGGAATATGAGATCTTTCTTCTATAAAGTTATTCATGCACAGGCAAAAATTGAGCTA

CACAGGTAGAATGTAGTTTTACTTAGAAGATTTTTGTGGGAGGTTTTGAAGCAAATATATAAAACAACTT

TCACTAATTTGCTTTCCATATTTAAAAAATAATAAATTACATTTATATAATAAATGTTTAAAGCACATAT

TTTTTGTTGTTCTGGCAATTTAAAAAGAAAGAGGATTTAAACGTACCTATAGAAACAAAGATTTATGGTT

AAAGAATGAGATCAGAAGTCTAGAATGTTTTTAAATTGTGATATATTTTACAACATCCGTTATTACTTTG

AGACATTTGTCCTAATCTACGTATAAAACTCAATCTAGGGCTAAAGATTCTTTATACCATCTTAGGTTCA

TTCATCTTAGGCTATTTGAACCACTTTTTAATTTAATATGAAAGACACCATGCAGTGTTTTCCGAGACTA

CATAGATCATTTTATCACATACCTACCAAGCCTGTTGGAAATAGGTTTTGATAATTTAAGTAGGGACCTA

TACAAAATATATTACATTTATCAGATTTTTAAATACATTCAATTAAGAATTTAACATCACCTTAAATTTG

AATTCAATCTACCGTTATTTCAAACTCACAAATATAACTGCATTATGAATACTTACATAATGTAGTAAGA

CAAGATGTTTGACAGGTTCGTGTGTAATTTTCTATTAATGTTTTTACATTGCCTTGTTTTTATGTAAAAT

AAAAAATATGGGCAACTGGTTTGTTAACAACACAATTTCTTCTTAGCATTTCAAAAATATATATAAAGTT

GTTCTTTTTCCTATTTCATGAACTATGTTTTTTTTTAAAATAACATGGTTAAGTTTTATATATATTTACG

TTTGTTTCAGGAATGTCTACTTGTGACTTTTTATCAATTAAAAATAATATTTGGAAGAAAGAGCTTATTA

AGTATAAGCTTGAAGTAAAATTAGACCTCTCTTTCCATGTAGATTACTGTTTGTACTGATGGTTTCACCC

TTCAGAAGGCACTGTCATATTAATATTTAAATTTTATAATCGCTGAACTTATTACACCCAACAATACAGA

AAGGCAGTTACACTGAAGAACTTAACTTAGAATAAAATGGAAGCAAACAGGTTTTCTAAAAACTTTTTA

AGTGACCAGGTCTCGCTCTGTCACCCAGGCTAGAGTGCAATGGCATGATCATAGCTCTCTGCAGCCTCAA

CTCTGGGCTCAAGCAACCCTCCTGCCTCAGCCTCCCAAGTAGCTAAGACTACAGGTACATGCCACCATGC

CTGGCTAATATTTAAATTTTTGTAGATAAGGGGTCTTGCTATGTTGCCCAGGCTAGTCTCAAACTCCTGG

CTTCAAGTGTTCCTACTGTCATGACCTGCCAACATGCTGGGGTTACAGGCATGAGCCACCATGCCCCAAA

CAGGTTTGAACACAAATCTTTCGGATGAAAATTAGAGAACCTAATTTTAGCTTTTTGATAGTTACCTAGT

TTGCAAAAGATTTGGGTGACTTGTGAGCTGTTTTTAAATGCTGATTGTTGAACATCACAACCCAAAATAC

-continued

TTAGCATGATTTTATAGAGTTTTGATAGCTTTATTAAAAAGAGTGAAAATAAAATGCATATGTAAATAAA

GCAGTTCTAAATAGCTATTTCAGAGAAATGTTAATAGAAGTGCTGAAAGAAGGGCCAACTAAATTAGGAT

GGCCAGGGAATTGGCCTGGGTTTAGGACCTATGTATGAAGGCCACCAATTTTTTAAAAATATCTGTGGTT

TATTATGTTATTATCTTCTTGAGGAAAACAATCAAGAATTGCTTCATGAAAATAAATAAATAGCCATGAA

TATCATAAAGCTGTTTACATAGGATTCTTTACAAATTTCATAGATCTATGAATGCTCAAAATGTTTGAGT

TTGCCATAAATTATATTGTAGTTATATTGTAGTTATACTTGAGACTGACACATTGTAATATAATCTAAGA

ATAAAAGTTATACAAAATAAAA

The reverse complement of SEQ ID NO: 4001 is provided as SEQ ID NO: 4002 herein:

(SEQ ID NO: 4002)

TTTTATTTTGTATAACTTTTATTCTTAGATTATATTACAATGTGTCAGTCTCAAGTATAACTACAATATA

ACTACAATATAATTTATGGCAAACTCAAACATTTTGAGCATTCATAGATCTATGAAATTTGTAAAGAATC

CTATGTAAACAGCTTTATGATATTCATGGCTATTTATTTATTTTCATGAAGCAATTCTTGATTGTTTTCC

TCAAGAAGATAATAACATAATAAACCACAGATATTTTTAAAAAATTGGTGGCCTTCATACATAGGTCCTA

AACCCAGGCCAATTCCCTGGCCATCCTAATTTAGTTGGCCCTTCTTTCAGCACTTCTATTAACATTTCTC

TGAAATAGCTATTTAGAACTGCTTTATTTACATATGCATTTTATTTTCACTCTTTTTAATAAAGCTATCA

AAACTCTATAAAATCATGCTAAGTATTTTGGGTTGTGATGTTCAACAATCAGCATTTAAAAACAGCTCAC

AAGTCACCCAAATCTTTTGCAAACTAGGTAACTATCAAAAAGCTAAAATTAGGTTCTCTAATTTTCATCC

GAAAGATTTGTGTTCAAACCTGTTTGGGGCATGGTGGCTCATGCCTGTAACCCCAGCATGTTGGCAGGTC

ATGACAGTAGGAACACTTGAAGCCAGGAGTTTGAGACTAGCCTGGGCAACATAGCAAGACCCCTTATCTA

CAAAAATTTAAATATTAGCCAGGCATGGTGGCATGTACCTGTAGTCTTAGCTACTTGGGAGGCTGAGGCA

GGAGGGTTGCTTGAGCCCAGAGTTGAGGCTGCAGAGAGCTATGATCATGCCATTGCACTCTAGCCTGGGT

GACAGAGCGAGACCTGGTCACTTAAAAAAGTTTTTAGAAAACCTGTTTGCTTCCATTTTATTCTAAGTTA

AGTTCTTCAGTGTAACTGCCTTTCTGTATTGTTGGGTGTAATAAGTTCAGCGATTATAAAATTTAAATAT

TAATATGACAGTGCCTTCTGAAGGGTGAAACCATCAGTACAAACAGTAATCTACATGGAAAGAGAGGTCT

AATTTTACTTCAAGCTTATACTTAATAAGCTCTTTCTTCCAAATATTATTTTTAATTGATAAAAAGTCAC

AAGTAGACATTCCTGAAACAAACGTAAATATATATAAAACTTAACCATGTTATTTTAAAAAAAAACATAG

TTCATGAAATAGGAAAAAGAACAACTTTATATATATTTTTGAAATGCTAAGAAGAAATTGTGTTGTTAAC

AAACCAGTTGCCCATATTTTTTATTTTACATAAAAACAAGGCAATGTAAAAACATTAATAGAAAATTACA

CACGAACCTGTCAAACATCTTGTCTTACTACATTATGTAAGTATTCATAATGCAGTTATATTTGTGAGTT

TGAAATAACGGTAGATTGAATTCAAATTTAAGGTGATGTTAAATTCTTAATTGAATGTATTTAAAAATCT

GATAAATGTAATATATTTTGTATAGGTCCCTACTTAAATTATCAAAACCTATTTCCAACAGGCTTGGTAG

GTATGTGATAAAATGATCTATGTAGTCTCGGAAAACACTGCATGGTGTCTTTCATATTAAATTAAAAAGT

GGTTCAAATAGCCTAAGATGAATGAACCTAAGATGGTATAAAGAATCTTTAGCCCTAGATTGAGTTTTAT

ACGTAGATTAGGACAAATGTCTCAAAGTAATAACGGATGTTGTAAAATATATCACAATTTAAAAACATTC

TAGACTTCTGATCTCATTCTTTAACCATAAATCTTTGTTTCTATAGGTACGTTTAAATCCTCTTTCTTTT

TAAATTGCCAGAACAACAAAAAATATGTGCTTTAAACATTTATTATATAAATGTAATTTATTATTTTTA

AATATGGAAAGCAAATTAGTGAAAGTTGTTTTATATATTTGCTTCAAAACCTCCCACAAAAATCTTCTAA

GTAAAACTACATTCTACCTGTGTAGCTCAATTTTTGCCTGTGCATGAATAACTTTATAGAAGAAAGATCT

CATATTCCTGAAATAAACTCACGAAAAAAAGCATTATGGTTATTTCTTTTCAAATTACTATTAATAGGTG

-continued

TTTTCAAAAAACTAGATGTCTACAGCTAATGCAAAATGAATATGTGCTTGATAAATTAGAAGCCCATGGT

ACTGTGTTGATTGAGGCAAAATATATTTCACATCATAGAATTTTAAGGAGAAGGTGACATCTTCCTCATT

GTATACATTGAAGTATATCCAAAAAAGATTACTTCCATAATTTAGGAAAGTAAGTTGGTGGCAAGAGAGC

AAGTTGGCAAGAATCCCTATTTCAATGCTTTTTTATTCATACTAAACACATATCTGTGTAAAGTCTGTCA

TATTACATGATTTGAAAGCTTGCCAAACACGGGATTGTATACAAGTGATGCAATAAATACTGTGCCCAAG

TTATTATCTGCTCAAGTATGTACCGTGGTCAAACAACTAACTGCATATCAGGAAGGATTTCATCAACTTT

GCTTACAGCGAAAGGATGACTAAACAATACTGCATAAGAAAGCAGGAAAATTTGACAAAAGAGTTTAAGA

GACTATTATCAGTATTTTGGGCAGCACAGTCAAATGTTAGGCTATGTAAATAATAGCAAATAGAACTTCT

GTCAATAACTTTTTTCTCAGTTATCTTTGTTTTTTTTGAGGAGTGTAATATGTACTTAGAATAATTTTTC

AAGTTCTGTGGTTATTCTATGAACAAAAAGGGATATGAAAGAAGAAAGGCTATGAAACACAATACTCTAA

AGGTAAGTCTTATCCTTGTTGGCATGTGAGTCAAGATGAATGAAAAACATTTGTAGAAATGAATAGCCTA

CATATATTTTTAATCCCATGGCATTTTATAGGCACATATAAATTGGTTCTGATGCAATGTAGAATAAATT

TAAGCACCTCAAAATATAGAATAACCTCTGTACATTGATAAAAAGTCAAGCTCCCTAATAATGCATTTTA

ACTAAACATTCATAACTAATGTCCATTACTTCTATCAAGCATTTCATTGCAAAGCCAAGGCAAATACTTT

TGTTGATTTCCAAATAATAGATAAATAATAGATTTTTCTGTATGCGTGTGTTGTTTATTTACATGGGAAA

CAAGACTAATTACAATCCTGTGAAAAGATGACAAGGCAGATGTAAAAGTTTTCTACATGGTCTTCTGATT

TATTAAAAACCAAAAAACTGAATCACTTTTGTATGCTATAATCAATAATTCCTACAGAGTTCTCTTACGA

TTCTTAAAGAATCATCAGTGCAAAAATAACCATCTGCTAATGCTGCCCACCTTTCTTAGGAAATCAGAGT

TAGTGACTGCACTGCCTTCGAGAATATTTTGATAAAAAGGATTTTGGCATAGACTTCCTCAAAAGAGTTT

TATTAACACAAATAAATCACTTTCACAGGCTGTAAACAATATATCAAAAATGAAGCTCTATTTTTTGCTT

TCCTTGCTGTCTTTCCCTTTGTCTTCCTTTTCTGTTCTGTCTTGTTCATATTTCTCTTTGTCTGGCTTTG

TTACACTATCATATGAAGGTGGAGAGGTGGTGGATGAAGTGGCATCTGTTTTTTCTGGACTTGAGTTCTC

ATTAACATTATCAAAAGCCATATCTTTTTTATTGAGTAAATCATCATCTCTGTCTCCATCTTTTATGTAT

ATACTTGATATATTTTTGACATTTTGCCTTAAGCGGTAACGTCTATAAGCACGCTGAATGACAGTAGCAG

ACACATCCTCTTGTTTCCGTTTTAGTGTGGTTGTGATGGGTTCATAGGACACTTTGGAAGGATTTGCAGA

CATGAACCTTTCTTCCATCTGTGAACGAAGAGAATCCATCTCCCCACTCTCACCCAAAACACGCTTTGTA

AAAGCAAATAAGATGTCAAGACAATGGATCCGGTCACCACTAACCATGGGCAGATCCATGGCAATGAGCT

GGACTTTGTTGGGTTTTGCTATGAGAAGAGGAGGATCCAGGGCAGCTGCAAAATCAGAGAGTTTAGAGAA

CTCTATAAACTGGGTCGCATCGGGATCAAACTTCTCCCAAACCTCATAGAACATCTCAAAGTCATCCTCA

CTCAGAGGTTCAGTACTTTCTTCAGTGGCAACACTAAAATTCTCCAGTATGACTGCAATGTACATGTTCA

CCACAACCAGGAAGGATATGATGATATAACTAACAAAGTAGAATATTCCAACAGATGGGTTACCACAGTC

TCCTTCAACTGAACTTCCAGGATGAACTTTTTTTGGGTCACAGTCGGGTGGCTTACTGTTAAGAATAGGT

GCTAGCAATCCATCCCAGCCAGCAGAGGTTGTAATTTGGAACAGGCAAATCATACTGTTGCCAAAGGTCT

CAAAATTGAACATGTCATTAATTCCATCTTCCTTTTTAACATAGGCAAAGTTGGACATTCCAAAGATGGC

GTAGATGAACATGACCAGGAAGAGCAGGAGGCCGATGTTAAACAACGCAGGAAGGGACATCATCAAAGCA

AAGAGCAGCGTGCGGATCCCCTTTGCTCCTTTGACTAGACGTAGGATTCGGCCAATCCTGGCAAGACGGA

TCACTCGGAACAGGGTAGGGGACACAAAATACGTTTCAATCAAATCAGCTAGAAACATACCTACAATGGA

GATAATCACAACCACAAAATCAAAAATATTCCATCCTACAGTGAAGTAGTAGTGTCTGAGGGAGATCAGT

TTTAGCACACATTCTCCAGTGAAAAGGATTATAAAAACCACATTTATCCAATATAAAACTTCAGTCATAT

GTTGACTTTGACCCTCCTTTTCTACCATCATGGTTACCATGTTGAGACAGATAAGAACCATGATACTAAT

ATCAAAGGCTTGATTTGTCACTAGGTCAAATATACATCCTTGGATTTTGTTCCCTGGTCGAGGAATTGGC

-continued

TTTTGTGGCTTCTTGGACCCCAGCTTTTTCATTGCATTATAGTATTTCTTCTGTTCTTCTGTCATAAAGA

TGTCTTGACCTCCAAGCTTCTTTTTCTGTTGGTTGAAATTATCTATGATGACACCAATGAACAAGTTCAA

AGTGAAGAATGACCCAAAGATGATAAAGACGACAAAATAAATATACATGTAGAGGCTATATTCATATTTG

GGCTGCTTGTCTACATTAACAGAATCCACTGCTGCATACATAATAATCGTCCATCCCTTAAAAGTTGCAA

CTTGAAGCAGAGATAGGTAACCAAGTCCGACATTATCAAAGTTCACTTTCAGGTTTTTCCATCGCACATT

TTGACTAACATTCATAAGGGCAAAACATTCGGAACGATTTGGAACTTGACTTGCAGGAAACCGTGACCCA

TCTGTGGTGTTAATACACTCATAGAACTTGCCAGCAAACAAATTTACTCCCATGATGCTGAATATCAGCC

AGAATATAAGACACACAAGTAGCACATTCATGATGGAAGGAATTGCTCCTATGAGTGCATTCACAACGAC

CCTCATTCCTTCAAATCTAGATAAGGCTCTTAGAGGTCTTAAAGCTCTCAGTGTCCGAAGGGATTTAATG

GGGCCAAGATCTGAGTAGCCAAGAGTGTTTGCCACTAAAGTAACCAAAGAAACATCAACAATTAGGAAAT

CCAGCCAACACCAGGCATTGGTGAAATATGTTTTATAACCATATGCTATCCATTTTAGAAGCATTTCCAG

AATGAAGATGTAAGTGAAGATCTTGTCTGCATACTCCAGGATAATCTTAATGGTCTTTTTCCTTTCAATA

TAAATATCTTCAAAAGCCAGGGCACCACTGCTGAGCAGGATCATGAGGACAATGAAGCTTTCAAACCAAC

TGTGTTCAACAATCTTGTAGCAGGTTTTCCTGATGTTCCACCAGATTTTTCCTTTCCCTGACTCTATGTT

AACTTGGCAGCATGAGAACCTCCATACACAACCATCTGTGAAACAGGCCTCTGGCTCATCGGAATTCATA

GGTTCAGCCTCTGCTTCTTCTCCTTCTCCAGGCAAAGGGTTATCAACTGTGCTGCACTCTGAGGAGCTTG

ACCGGTTTAATCTCACTTTGCTGTATTCACTATCCGAATCACTGCTAAGTTCCTCAGCATTCATATTTTC

CAAATCGGATTCCCCAGGTGCAATTGGCACTGTCACTGTGAGGCTGGGATTGTGAATAAATGATTGACCA

TCACTGTCTTCCATCAAGTGTTTGTCCACGCTGCTTCCAAAACCACTGATTTTATCTTTTTCCTTGAGGA

AATTGTGACCTTTGCTCATTTCAGCAAGTGTATGGTTAGAAATATAGTTTTCCTTCTTAGTATTCAGATC

TTCTGCTTGTCTTATCTCCCTGGAAATCTTTGGCTTTTTGGAAAATGCTTTTAGAATAAATTCACGTAAG

GTTTGTTTCACATAATTTATTCCCTTTTTAATTCTAGTCACTGCAATCTGGAGGTTGTTTGCATCAGGGT

CTTCTTCAATTGCTGTAAGATTGTCTGAACTAAATGAGCTCAATAATAAGGCCAGAAATAGGTTTAGGAC

CACCAGGTTTCCAATGACCATGACCATCATGTAAACAATAAGGCACATAGCTTGACCAGCGACCTCCATA

CAGTCCCACATGGTCTCTATCCACTCTCCACACAGCACGCGGAACACAATCAGGAAGGAGTGGAAGAAGT

CGTTCATGTGCCACCGTGGGAGCGTACAGTCATCATTGATCTTGCAGACACATTCTTTGTAGCTCTTACC

AAAGAGCTGCATGCCGACCACAGCAAAAATGAAGACGATGATGGCCAACACTAAGGTGAGGTTACCTAGA

GCCCCTACTGAGTTACCAATGATCTTAATCAGCATGTTCAATGTTGGCCAGGATTTTGCCAACTTGAAGA

CTCGGAGCAGTCTGAATGATCGCAGAACTGACAATCCTTCCACATCTGCTAGAAAGAGCTCCACTAAACT

TAAAGTCACAATAAGGCTGTCAAAAATATTCCAGCCTACTTGGAAATACTCATATGGATCCATGGCAATC

AGTTTTAATACCATTTCAGCTGCAAAGATTCCAGTAAAGACCAAATTTCCTATAGCAAGTACATTTTTGA

ATTCCTCAGTCATTGGGTGGTGTTCCATAGCCATAAATAATGTGTTTAAAACTATGCAAATGGTAATTGC

AAGATCTACAAAAGGATCCATTACAATAAAATAGATACACTTTTTGAATTTTATCCAATATGGAGAGCAA

TTCCAGATCAAGAATTTGTGTGCAAATCTGTACCACCAAGGTGGACATTTTTGTCTGGACTCTTCAAGTT

CTTCCACAGTGTTTGTTAATATGCTTGCTCTACTCATTGCTCTCTGTCTGAGGTTGGGATCATTCAGCAT

ATCCTCTGAAAGGAGATAGGAACTACAACGCCTTTTCTTGTGTATTTGATTGGTCGTGCCGCTGTCATCA

GAAGTTGCCTTATCTATTATCACCTCTGGCAGAAGCTGTCCATTGGGGAGCATGAGGGCTGAGCGTCCAT

CAACCAGGGAGACCACACCGTTGCAGTCCACAGCACTGTGCATTTTCCCGTTCACCGGCAGCATTGGTGG

GGACCTACTGGCTTGGCTGATGTTACTGCTGCGTCGCTCCTGGGGTCTGTGGGGCACAAACAGTGAGCCC

CTTCTGCTCTCATTGTCTCCAAAAATGCTGTGCTCATCATCGGCAAATTCAGTCTCAGATCCTATATCTC

-continued

```
TTCCTCTGCCTTTGAAACTAAAAAGACTTGTTCTGCTGCTTCGCCTTGCAGAAAACAAGGAGCCACGAAT

GCTGAGTGGTGACTGATTGGGGGTAGACAACCTCTTTTCATGTGCTCGCCTATGCCCTTCGACACCAAGG

TGGAAACTTTTTCTTCTGATGCTGTCCTCTGATTCTGATTTCGACAATTTCTCAGCATCTCCCTTTTCCT

CTCCACTGGAGAGCTTCTTTTGATTCTTTTTCTTTCTTCTGTTTCTTCTTTCTTTAGCACTTTTAGAGCT

CAGTTTGGATGTTTCAGAAGAACTCTCTGAGAGGCCCATAATTCTGCTTCTCCTAATACTTGTATATTCA

GCCGCTGCCGCTGCAATTGCCTCAGCTTCTTCTTGCTCTTTTTTAAGACGGTCTAACATCTGTTGAAATT

CTAATTCTTTCTGTTTAGCTTCTTCAATGTTTGCCTGGTTCTGTTCTTCATATGCCATGGCAACCACAGC

CAGGATCAAGTTTATTAGATAAAAGGAGCCCAGGAAAATCACTACGACAAAGAAGATCATGTAGGTTTTG

CCAGCAGCACGCAGCGTCTGTTGGTAAAGGTTTTCCCAGTAATCTTGGGTCATTAGCCTAAACAAGGCTA

AGAAGGCCCAGCTGAAAGTGTCAAAGCTCGTGTAGCCATAATCAGGGTTTCTGCCAATTTTCACACAGGT

GTACCCCTCTGGACACTGACCTGAATCTGTGCTGAAACCACAAAGGAGAGCATCTTTGGATCCTTCCAAG

TAATAAAAATATTTTCTAAAGTCTTCTTCACTCTCTAGGGTATTCATTATGCTTTCTAATGTTTCATTAT

TTTCAAGTGAATTTCGAAAACATTTATGCTTCAGGTTTCCCATGAACAGCTGTAGTCCAATTAGTGCAAA

CACACTCAGACAGAACACAGTCAGGATCATGACATCAGAAAGCTTCTTCACTGACTGGATCAAAGCCCCT

ACAATTGTCTTCAGGCCTGGGATTACAGAAATAGTTTTCAAAGCTCTCAATACTCTGAAAGTTCGAAGAG

CTGAAACATTGCCTAGGTTTACAAATTCTGTTAAATACGCAAAAACAATGACGACAAAATCCAGCCAGTT

CCACGGGTCACGAAGAAAAGTGAATTCTCCTACACAGAAGCCTCTTGCAAGGATTTTTACAAGTGATTCA

AAAGTATATATTCCAGTAAAAGTGTACTCGACATTTTTGGTCCAGTCCGGTGGGTTATTCATGGTCATAA

ATATGCAGTTTGTCAGAATAGTGCACATGATGAGCATGCTGAATAAGGAGTGTACTAAAATCTTAATAGA

TATTCTTCTTAGAGGACTGAAAGGAGAAAGCATATATAAAGCAGGTGTGGCATTGAAACGGAAGATTGTT

TTCCCTTTGTTCAATACTATGAAAGTCTTTTTGTCTGCATAGTAGGGGTCCAAGTCCTCCAGGGGCTCTG

ACACCATGCCGGGAGGAATGTCCCCATAGATGAAGGGCAGCTGTTTGCCAGCTTCCAAGTCACTGCTTGG

CTTTGGGGCTTCTTCATCATCATCTTTCTTTTCTTCTTTGGGTTCCTTTGATTTTCTTTCAGCAATGCGT

TGTTCAATGAGGGCAAGAGACTGTTTTGTGAAATGGACAAAGCTCTGAGGTCCTGGGGGAGGCAACATTG

CCATCTTTTCATCCTGTATATTTTAATTCCTCTTCAGCTCCTCACATAAGAGGCTTGCAACCTAGCCCGC

CGATCATCCCCACCCAGTGCACCTGCAGAATCTGGCTCCAGGAGAGGGCGCGGCCTCTCCTTCCCCGGC

GCTCTCTCAGGGCTGCTTCTTTTTCTCTGGGCTCCTGTTGCTCAGGGGACGCCTGCCGCTAGCAGCCACT

GGCACCCAGGCTAGCCCAGCCTCAGCCGAGCTGGCGGAATTGGAAAGCCGACAGCCGCCGCTGGAGCGCT

GGCGACCGCCTGCAAGCAGACT
```

In some embodiments, an iRNA described herein includes at least 15 contiguous nucleotides from 50 one of the sequences provided in Tables 2A, 2B, 4A, 4B, 5A, 5B, 6A, 6B, 13A, 13B, 14A, 14B, 15A, 15B, 16, 18, and 20, and may optionally be coupled to additional nucleotide sequences taken from the region contiguous to the selected sequence in SCN9A.

While a target sequence is generally 15-30 nucleotides in length, there is wide variation in the suitability of particular sequences in this range for directing cleavage of any given target RNA. Various software packages and the guidelines set out herein provide guidance for the identification of optimal target sequences for any given gene target, but an empirical approach can also be taken in which a "window" or "mask" of a given size (as a non-limiting example, 21 nucleotides) is literally or figuratively (including, e.g., in silico) placed on the target RNA sequence to identify sequences in the size range that may serve as target sequences. By moving the sequence "window" progressively one nucleotide upstream or downstream of an initial target sequence location, the next potential target sequence can be identified, until the complete set of possible sequences is identified for any given target size selected. This process, coupled with systematic synthesis and testing of the identified sequences (using assays described herein or known in the art) to identify those sequences that perform optimally can identify those RNA sequences that, when targeted with an iRNA agent, mediate the best inhibition of target gene expression. Thus, it is contemplated that further optimization of inhibition efficiency can be achieved by progressively "walking the window" one nucleotide upstream or downstream of the given sequences to identify sequences with equal or better inhibition characteristics.

Further, it is contemplated that for any sequence identified, e.g., in Tables 2A, 4A, 5A, 6A, 13A, 14A, 15A, 16, 18, and 20, further optimization can be achieved by systematically either adding or removing nucleotides to generate longer or shorter sequences and testing those and sequences generated by walking a window of the longer or shorter size up or down the target RNA from that point. Again, coupling this approach to generating new candidate targets with testing for effectiveness of iRNAs based on those target sequences in an inhibition assay as known in the art or as described herein can lead to further improvements in the efficiency of inhibition. Further still, such optimized sequences can be adjusted by, e.g., the introduction of modified nucleotides as described herein or as known in the art, addition or changes in overhang, or other modifications as known in the art and/or discussed herein to further optimize the molecule (e.g., increasing serum stability or circulating half-life, increasing thermal stability, enhancing transmembrane delivery, targeting to a particular location or cell type, increasing interaction with silencing pathway enzymes, increasing release from endosomes, etc.) as an expression inhibitor.

In some embodiments, the disclosure provides an iRNA, e.g., in Tables 2B, 4B, 5B, 6B, 13B, 14B, an 15B, that is un-modified or un-conjugated. In some embodiments, an RNAi agent of the disclosure has a nucleotide sequence as provided in any of Tables 2A, 4A, 5A, 6A, 13A, 14A, 15A, 16, 18, or 20, but lacks one or more ligand or moiety shown in the table. A ligand or moiety (e.g., a lipophilic ligand or moiety) can be included in any of the positions provided in the instant application.

An iRNA as described herein can contain one or more mismatches to the target sequence. In some embodiments, an iRNA as described herein contains no more than 3 mismatches. In some embodiments, when the antisense strand of the iRNA contains mismatches to a target sequence, the area of mismatch is not located in the center of the region of complementarity. In some embodiments, when the antisense strand of the iRNA contains mismatches to the target sequence, the mismatch is restricted to be within the last 5 nucleotides from either the 5' or 3' end of the region of complementarity. For example, for a 23 nucleotide iRNA agent RNA strand which is complementary to a region of SCN9A, the RNA strand generally does not contain any mismatch within the central 13 nucleotides. The methods described herein, or methods known in the art can be used to determine whether an iRNA containing a mismatch to a target sequence is effective in inhibiting the expression of SCN9A. Consideration of the efficacy of iRNAs with mismatches in inhibiting expression of SCN9A is important, especially if the particular region of complementarity in a SCN9A gene is known to have polymorphic sequence variation within the population.

In some embodiments, at least one end of a dsRNA has a single-stranded nucleotide overhang of 1 to 4, generally 1 or 2 nucleotides. In some embodiments, dsRNAs having at least one nucleotide overhang have superior inhibitory properties relative to their blunt-ended counterparts. In some embodiments, the RNA of an iRNA (e.g., a dsRNA) is chemically modified to enhance stability or other beneficial characteristics. The nucleic acids featured in the disclosure may be synthesized and/or modified by methods well established in the art, such as those described in "Current protocols in nucleic acid chemistry," Beaucage, S. L. et al. (Edrs.), John Wiley & Sons, Inc., New York, NY, USA, which is hereby incorporated herein by reference. Modifications include, for example, (a) end modifications, e.g., 5' end modifications (phosphorylation, conjugation, inverted linkages, etc.) 3' end modifications (conjugation, DNA nucleotides, inverted linkages, etc.), (b) base modifications, e.g., replacement with stabilizing bases, destabilizing bases, or bases that base pair with an expanded repertoire of partners, removal of bases (abasic nucleotides), or conjugated bases, (c) sugar modifications (e.g., at the 2' position or 4' position, or having an acyclic sugar) or replacement of the sugar, as well as (d) backbone modifications, including modification or replacement of the phosphodiester linkages. Specific examples of RNA compounds useful in this disclosure include, but are not limited to, RNAs containing modified backbones or no natural internucleoside linkages. RNAs having modified backbones include, among others, those that do not have a phosphorus atom in the backbone. For the purposes of this specification, and as sometimes referenced in the art, modified RNAs that do not have a phosphorus atom in their internucleoside backbone can also be considered to be oligonucleosides. In particular embodiments, the modified RNA will have a phosphorus atom in its internucleoside backbone.

Modified RNA backbones include, for example, phosphorothioates, chiral phosphorothioates, phosphorodithioates, phosphotriesters, aminoalkylphosphotriesters, methyl and other alkyl phosphonates including 3'-alkylene phosphonates and chiral phosphonates, phosphinates, phosphoramidates including 3'-amino phosphoramidate and aminoalkylphosphoramidates, thionophosphoramidates, thionoalkylphosphonates, thionoalkylphosphotriesters, and boranophosphates having normal 3'-5' linkages, 2'-5' linked analogs of these, and those) having inverted polarity wherein the adjacent pairs of nucleoside units are linked 3'-5' to 5'-3' or 2'-5' to 5'-2'. Various salts, mixed salts and free acid forms are also included.

Representative U.S. patents that teach the preparation of the above phosphorus-containing linkages include, but are not limited to, U.S. Pat. Nos. 3,687,808; 4,469,863; 4,476,301; 5,023,243; 5,177,195; 5,188,897; 5,264,423; 5,276,019; 5,278,302; 5,286,717; 5,321,131; 5,399,676; 5,405,939; 5,453,496; 5,455,233; 5,466,677; 5,476,925; 5,519,126; 5,536,821; 5,541,316; 5,550,111; 5,563,253; 5,571,799; 5,587,361; 5,625,050; 6,028,188; 6,124,445; 6,160,109; 6,169,170; 6,172,209; 6,239,265; 6,277,603; 6,326,199; 6,346,614; 6,444,423; 6,531,590; 6,534,639; 6,608,035; 6,683,167; 6,858,715; 6,867,294; 6,878,805; 7,015,315; 7,041,816; 7,273,933; 7,321,029; and U.S. Pat. RE39464, each of which is herein incorporated by reference.

Modified RNA backbones that do not include a phosphorus atom therein have backbones that are formed by short chain alkyl or cycloalkyl internucleoside linkages, mixed heteroatoms and alkyl or cycloalkyl internucleoside linkages, or one or more short chain heteroatomic or heterocyclic internucleoside linkages. These include those having morpholino linkages (formed in part from the sugar portion of a nucleoside); siloxane backbones; sulfide, sulfoxide and sulfone backbones; formacetyl and thioformacetyl backbones; methylene formacetyl and thioformacetyl backbones; alkene containing backbones; sulfamate backbones; methyleneimino and methylenehydrazino backbones; sulfonate and sulfonamide backbones; amide backbones; and others having mixed N, O, S and $CH_2$ component parts.

Representative U.S. patents that teach the preparation of the above oligonucleosides include, but are not limited to, U.S. Pat. Nos. 5,034,506; 5,166,315; 5,185,444; 5,214,134; 5,216,141; 5,235,033; 5,64,562; 5,264,564; 5,405,938; 5,434,257; 5,466,677; 5,470,967; 5,489,677; 5,541,307; 5,561,225; 5,596,086; 5,602,240; 5,608,046; 5,610,289; 5,618,704; 5,623,070; 5,663,312; 5,633,360; 5,677,437; and, 5,677,439, each of which is herein incorporated by reference.

In other RNA mimetics suitable or contemplated for use in iRNAs, both the sugar and the internucleoside linkage, i.e., the backbone, of the nucleotide units are replaced with novel groups. The base units are maintained for hybridization with an appropriate nucleic acid target compound. One such oligomeric compound, an RNA mimetic that has been shown to have excellent hybridization properties, is referred to as a peptide nucleic acid (PNA). In PNA compounds, the sugar backbone of an RNA is replaced with an amide containing backbone, in particular an aminoethylglycine backbone. The nucleobases are retained and are bound directly or indirectly to aza nitrogen atoms of the amide portion of the backbone. Representative U.S. patents that teach the preparation of PNA compounds include, but are not limited to, U.S. Pat. Nos. 5,539,082; 5,714,331; and 5,719,262, each of which is herein incorporated by reference. Further teaching of PNA compounds can be found, for example, in Nielsen et al., Science, 1991, 254, 1497-1500.

Some embodiments featured in the disclosure include RNAs with phosphorothioate backbones and oligonucleosides with heteroatom backbones, and in particular $—CH_2—NH—CH_2—$, $—CH_2—N(CH_3)—O—CH_2—$ [known as a methylene (methylimino) or MMI backbone], $—CH_2—O—N(CH_3)—CH_2—$, $—CH_2—N(CH_3)—N(CH_3)—CH_2—$ and $—N(CH_3)—CH_2—CH_2—$ of the above-referenced U.S. Pat. No. 5,489,677, and the amide backbones of the above-referenced U.S. Pat. No. 5,602,240. In some embodiments, the RNAs featured herein have morpholino backbone structures of the above-referenced U.S. Pat. No. 5,034,506. The native phosphodiester backbone can be represented as $O—P(O)(OH)—OCH_2—$.

Modified RNAs may also contain one or more substituted sugar moieties. The iRNAs, e.g., dsRNAs, featured herein can include one of the following at the 2' position: OH; F; O-, S-, or N-alkyl; O-, S-, or N-alkenyl; O-, S- or N-alkynyl; or O-alkyl-O-alkyl, wherein the alkyl, alkenyl and alkynyl may be substituted or unsubstituted $C_1$ to $C_{10}$ alkyl or $C_2$ to $C_{10}$ alkenyl and alkynyl. Exemplary suitable modifications include $O[(CH_2)_nO]_mCH_3$, $O(CH_2)_nOCH_3$, $O(CH_2)_nNH_2$, $O(CH_2)_nCH_3$, $O(CH_2)_nONH_2$, and $O(CH_2)_nON[(CH_2)_nCH_3)]_2$, where n and m are from 1 to about 10. In other embodiments, dsRNAs include one of the following at the 2' position: $C_1$ to $C_{10}$ lower alkyl, substituted lower alkyl, alkaryl, aralkyl, O-alkaryl or O-aralkyl, SH, $SCH_3$, OCN, Cl, Br, CN, $CF_3$, $OCF_3$, $SOCH_3$, $SO_2CH_3$, $ONO_2$, $N_3$, $NH_2$, heterocycloalkyl, heterocycloalkaryl, aminoalkylamino, polyalkylamino, substituted silyl, an RNA cleaving group, a reporter group, an intercalator, a group for improving the pharmacokinetic properties of an iRNA, or a group for improving the pharmacodynamic properties of an iRNA, and other substituents having similar properties. In some embodiments, the modification includes a 2'-methoxyethoxy ($2'-O—CH_2CH_2OCH_3$, also known as 2'-O-(2-methoxyethyl) or 2'-MOE) (Martin et al., *Helv. Chim. Acta,* 1995, 78:486-504) i.e., an alkoxy-alkoxy group. Another exemplary modification is 2'-dimethylaminooxyethoxy, i.e., a $O(CH_2)_2ON(CH_3)_2$ group, also known as 2'-DMAOE, and 2'-dimethylaminoethoxyethoxy (also known in the art as 2'-O-dimethylaminoethoxyethyl or 2'-DMAEOE), i.e., $2'-O—CH_2—O—CH_2—N(CH_3)_2$.

In other embodiments, an iRNA agent comprises one or more (e.g., about 1, 2, 3, 4, 5, 6, 7, 8, 9, 10, or more) acyclic nucleotides (or nucleosides). In certain embodiments, the sense strand or the antisense strand, or both sense strand and antisense strand, include less than five acyclic nucleotides per strand (e.g., four, three, two or one acyclic nucleotides per strand). The one or more acyclic nucleotides can be found, for example, in the double-stranded region, of the sense or antisense strand, or both strands; at the 5'-end, the 3'-end, both of the 5' and 3'-ends of the sense or antisense strand, or both strands, of the iRNA agent. In some embodiments, one or more acyclic nucleotides are present at positions 1 to 8 of the sense or antisense strand, or both. In some embodiments, one or more acyclic nucleotides are found in the antisense strand at positions 4 to 10 (e.g., positions 6-8) from the 5'-end of the antisense strand. In some embodiments, the one or more acyclic nucleotides are found at one or both 3'-terminal overhangs of the iRNA agent.

The term "acyclic nucleotide" or "acyclic nucleoside" as used herein refers to any nucleotide or nucleoside having an acyclic sugar, e.g., an acyclic ribose. An exemplary acyclic nucleotide or nucleoside can include a nucleobase, e.g., a naturally occurring or a modified nucleobase (e.g., a nucleobase as described herein). In certain embodiments, a bond between any of the ribose carbons (C1, C2, C3, C4, or C5), is independently or in combination absent from the nucleotide. In some embodiments, the bond between C2-C3 carbons of the ribose ring is absent, e.g., an acyclic 2'-3'-seco-nucleotide monomer. In other embodiments, the bond between C1-C2, C3-C4, or C4-C5 is absent (e.g., a 1'-2', 3'-4' or 4'-5'-seco nucleotide monomer). Exemplary acyclic nucleotides are disclosed in U.S. Pat. No. 8,314,227, incorporated herein by reference in its entirely. For example, an acyclic nucleotide can include any of monomers D-J in FIGS. 1-2 of U.S. Pat. No. 8,314,227. In some embodiments, the acyclic nucleotide includes the following monomer:

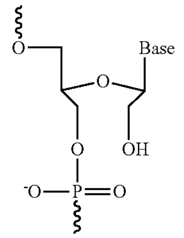

wherein Base is a nucleobase, e.g., a naturally occurring or a modified nucleobase (e.g., a nucleobase as described herein).

In certain embodiments, the acyclic nucleotide can be modified or derivatized, e.g., by coupling the acyclic nucleotide to another moiety, e.g., a ligand (e.g., a GalNAc, a cholesterol ligand), an alkyl, a polyamine, a sugar, a polypeptide, among others.

In other embodiments, the iRNA agent includes one or more acyclic nucleotides and one or more LNAs (e.g., an LNA as described herein). For example, one or more acyclic nucleotides and/or one or more LNAs can be present in the sense strand, the antisense strand, or both. The number of acyclic nucleotides in one strand can be the same or different from the number of LNAs in the opposing strand. In certain embodiments, the sense strand and/or the antisense strand comprises less than five LNAs (e.g., four, three, two or one LNAs) located in the double stranded region or a 3'-overhang. In other embodiments, one or two LNAs are located in the double stranded region or the 3'-overhang of the sense strand. Alternatively, or in combination, the sense strand and/or antisense strand comprises less than five acyclic nucleotides (e.g., four, three, two or one acyclic nucleotides) in the double-stranded region or a 3'-overhang. In some embodiments, the sense strand of the iRNA agent comprises one or two LNAs in the 3'-overhang of the sense strand, and one or two acyclic nucleotides in the double-stranded region of the antisense strand (e.g., at positions 4 to 10 (e.g., positions 6-8) from the 5'-end of the antisense strand) of the iRNA agent.

In other embodiments, inclusion of one or more acyclic nucleotides (alone or in addition to one or more LNAs) in the iRNA agent results in one or more (or all) of: (i) a reduction in an off-target effect; (ii) a reduction in passenger strand participation in RNAi; (iii) an increase in specificity of the guide strand for its target mRNA; (iv) a reduction in a microRNA off-target effect; (v) an increase in stability; or (vi) an increase in resistance to degradation, of the iRNA molecule.

Other modifications include 2'-methoxy (2'-OCH3), 2'-5 aminopropoxy (2'-OCH2CH2CH2NH2) and 2'-fluoro (2'-F) Similar modifications may also be made at other positions on the RNA of an iRNA, particularly the 3' position of the sugar on the 3' terminal nucleotide or in 2'-5' linked dsRNAs and the 5' position of 5' terminal nucleotide. iRNAs may also have sugar mimetics such as cyclobutyl moieties in place of the pentofuranosyl sugar. Representative U.S. patents that teach the preparation of such modified sugar structures include, but are not limited to, U.S. Pat. Nos. 4,981,957; 5,118,800; 5,319,080; 5,359,044; 5,393,878; 5,446,137; 5,466,786; 5,514,785; 5,519,134; 5,567,811; 5,576,427; 5,591,722; 5,597,909; 5,610,300; 5,627,053; 5,639,873; 5,646,265; 5,658,873; 5,670,633; and 5,700,920, certain of which are commonly owned with the instant application, and each of which is herein incorporated by reference.

An iRNA may also include nucleobase (often referred to in the art simply as "base") modifications or substitutions. As used herein, "unmodified" or "natural" nucleobases include the purine bases adenine (A) and guanine (G), and the pyrimidine bases thymine (T), cytosine (C) and uracil (U). Modified nucleobases include other synthetic and natural nucleobases such as 5-methylcytosine (5-me-C), 5-hydroxymethyl cytosine, xanthine, hypoxanthine, 2-aminoadenine, 6-methyl and other alkyl derivatives of adenine and guanine, 2-propyl and other alkyl derivatives of adenine and guanine, 2-thiouracil, 2-thiothymine and 2-thiocytosine, 5-halouracil and cytosine, 5-propynyl uracil and cytosine, 6-azo uracil, cytosine and thymine, 5-uracil (pseudouracil), 4-thiouracil, 8-halo, 8-amino, 8-thiol, 8-thioalkyl, 8-hydroxyl anal other 8-substituted adenines and guanines, 5-halo, particularly 5-bromo, 5-trifluoromethyl and other 5-substituted uracils and cytosines, 7-methylguanine and 7-methyladenine, 8-azaguanine and 8-azaadenine, 7-deazaguanine and 7-daazaadenine and 3-deazaguanine and 3-deazaadenine.

Further modified nucleobases include those disclosed in U.S. Pat. No. 3,687,808, those disclosed in Modified Nucleosides in Biochemistry, Biotechnology and Medicine, Herdewijn, P. ed. Wiley-VCH, 2008; those disclosed in The Concise Encyclopedia of Polymer Science and Engineering, pages 858-859, Kroschwitz, J. L, ed. John Wiley & Sons, 1990, these disclosed by Englisch et al., *Angewandte Chemie*, International Edition, 1991, 30, 613, and those disclosed by Sanghvi, Y S., Chapter 15*, dsRNA Research and Applications*, pages 289-302, Crooke, S. T. and Lebleu, B., Ed., CRC Press, 1993. Certain of these modified nucleobases are particularly useful for increasing the binding affinity of the oligomeric compounds featured in the disclosure. These include 5-substituted pyrimidines, 6-azapyrimidines and N-2, N-6 and O-6 substituted purines, including 2-aminopropyladenine, 5-propynyluracil and 5-propynylcytosine. 5-methylcytosine substitutions have been shown to increase nucleic acid duplex stability by 0.6-1.2° C. (Sanghvi, Y. S., Crooke, S. T. and Lebleu, B., Eds., dsRNA Research and Applications, CRC Press, Boca Raton, 1993, pp. 276-278) and are exemplary base substitutions, even more particularly when combined with 2'-O-methoxyethyl sugar modifications.

Representative U.S. patents that teach the preparation of certain of the above noted modified nucleobases as well as other modified nucleobases include, but are not limited to, the above noted U.S. Pat. No. 3,687,808, as well as U.S. Pat. Nos. 4,845,205; 5,130,302; 5,134,066; 5,175,273; 5,367,066; 5,432,272; 5,457,187; 5,459,255; 5,484,908; 5,502,177; 5,525,711; 5,552,540; 5,587,469; 5,594,121, 5,596,091; 5,614,617; 5,681,941; 6,015,886; 6,147,200; 6,166,197; 6,222,025; 6,235,887; 6,380,368; 6,528,640; 6,639,062; 6,617,438; 7,045,610; 7,427,672; and 7,495,088, each of which is herein incorporated by reference, and U.S. Pat. No. 5,750,692, also herein incorporated by reference.

The RNA of an iRNA can also be modified to include one or more (e.g., about 1, 2, 3, 4, 5, 6, 7, 8, 9, 10, or more) bicyclic sugar moities. A "bicyclic sugar" is a furanosyl ring modified by the bridging of two atoms. A "bicyclic nucleoside" ("BNA") is a nucleoside having a sugar moiety comprising a bridge connecting two carbon atoms of the sugar ring, thereby forming a bicyclic ring system. In certain embodiments, the bridge connects the 4'-carbon and the 2'-carbon of the sugar ring. Thus, in some embodiments an agent of the disclosure may include one or more locked nucleic acids (LNAs) (also referred to herein as "locked nucleotides"). In some embodiments, a locked nucleic acid is a nucleotide having a modified ribose moiety in which the ribose moiety comprises an extra bridge connecting, e.g., the 2' and 4' carbons. This structure effectively "locks" the ribose in the 3'-endo structural conformation. The addition of locked nucleic acids to siRNAs has been shown to increase siRNA stability in serum, increase thermal stability, and to reduce off-target effects (Elmen, J. et al., (2005) *Nucleic Acids Research* 33(1):439-447; Mook, O R. et al., (2007) *Mol Canc Ther* 6(3):833-843; Grunweller, A. et al., (2003) *Nucleic Acids Research* 31(12):3185-3193).

Examples of bicyclic nucleosides for use in the polynucleotides of the disclosure include without limitation nucleosides comprising a bridge between the 4' and the 2' ribosyl ring atoms. In certain embodiments, the antisense polynucleotide agents of the disclosure include one or more bicyclic nucleosides comprising a 4' to 2' bridge. Examples of such 4' to 2' bridged bicyclic nucleosides, include but are not limited to 4'-(CH2)-O-2' (LNA); 4'-(CH2)-S-2'; 4'-$(CH2)_2$—O-2' (ENA); 4'-CH(CH3)-O-2' (also referred to as "constrained ethyl" or "cEt") and 4'-CH(CH2OCH3)-O-2' (and analogs thereof; see, e.g., U.S. Pat. No. 7,399,845); 4'-C(CH3)(CH3)-O-2' (and analogs thereof; see e.g., U.S. Pat. No. 8,278,283); 4'-CH2-N(OCH3)-2' (and analogs thereof; see e.g., U.S. Pat. No. 8,278,425); 4'-CH2-O—N(CH3)-2' (see, e.g., U.S. Patent Publication No. 2004/0171570); 4'-CH2-N(R)—O-2', wherein R is H, C1-C12 alkyl, or a protecting group (see, e.g., U.S. Pat. No. 7,427,672); 4'-CH2-C(H)(CH3)-2' (see, e.g., Chattopadhyaya et al., *J. Org. Chem.,* 2009, 74, 118-134); and 4'-CH2-C(H2)-2' (and analogs thereof; see, e.g., U.S. Pat. No. 8,278,426). The contents of each of the foregoing are incorporated herein by reference for the methods provided therein. Representative U.S. patents that teach the preparation of locked nucleic acids include, but are not limited to, the following: U.S. Pat. Nos. 6,268,490; 6,670,461; 6,794,499; 6,998,484; 7,053,207; 7,084,125; 7,399,845, and 8,314,227, each of which is herein incorporated by reference in its entirety. Exemplary LNAs include but are not limited to, a 2', 4'-C methylene bicyclo nucleotide (see for example Wengel et al., International PCT 5 Publication No. WO 00/66604 and WO 99/14226).

Any of the foregoing bicyclic nucleosides can be prepared having one or more stereochemical sugar configurations including for example α-L-ribofuranose and β-D-ribofuranose (see WO 99/14226).

A RNAi agent of the disclosure can also be modified to include one or more constrained ethyl nucleotides. As used herein, a "constrained ethyl nucleotide" or "cEt" is a locked nucleic acid comprising a bicyclic sugar moiety comprising a 4'-CH(CH3)-0-2' bridge. In some embodiments, a constrained ethyl nucleotide is in the S conformation referred to herein as "S-cEt."

A RNAi agent of the disclosure may also include one or more "conformationally restricted nucleotides" ("CRN"). CRN are nucleotide analogs with a linker connecting the C2' and C4' carbons of ribose or the C3 and —C5' carbons of ribose. CRN lock the ribose ring into a stable conformation and increase the hybridization affinity to mRNA. The linker is of sufficient length to place the oxygen in an optimal position for stability and affinity resulting in less ribose ring puckering.

Representative publications that teach the preparation of certain of the above noted CRN include, but are not limited to, US 2013/0190383; and WO 2013/036868, the contents of each of which are hereby incorporated herein by reference for the methods provided therein.

In some embodiments, a RNAi agent of the disclosure comprises one or more monomers that are UNA (unlocked nucleic acid) nucleotides. UNA is unlocked acyclic nucleic acid, wherein any of the bonds of the sugar has been removed, forming an unlocked "sugar" residue. In one example, UNA also encompasses monomer with bonds between C1'-C4' have been removed (i.e. the covalent carbon-oxygen-carbon bond between the C1' and C4' carbons). In another example, the C2'-C3' bond (i.e. the covalent carbon-carbon bond between the C2' and C3' carbons) of the sugar has been removed (see *Nuc. Acids Symp. Series,* 52, 133-134 (2008) and Fluiter et al., *Mol. Biosyst.,* 2009, 10, 1039).

Representative U.S. publications that teach the preparation of UNA include, but are not limited to, U.S. Pat. No. 8,314,227; and US Patent Publication Nos. 2013/0096289; 2013/0011922; and 2011/0313020, the contents of each of which are hereby incorporated herein by reference for the methods provided therein.

In other embodiments, the iRNA agents include one or more (e.g., about 1, 2, 3, 4, 5, 6, 7, 8, 9, 10, or more) G-clamp nucleotides. A G-clamp nucleotide is a modified cytosine analog wherein the modifications confer the ability to hydrogen bond both Watson-Crick and Hoogsteen faces of a complementary guanine within a duplex, see for example Lin and Matteucci, 1998, *J. Am. Chem. Soc.,* 120, 8531-8532. A single G-clamp analog substitution within an oligonucleotide can result in substantially enhanced helical thermal stability and mismatch discrimination when hybridized to complementary oligonucleotides. The inclusion of such nucleotides in the iRNA molecules can result in enhanced affinity and specificity to nucleic acid targets, complementary sequences, or template strands.

Potentially stabilizing modifications to the ends of RNA molecules can include N-(acetylaminocaproyl)-4-hydroxyprolinol (Hyp-C6-NHAc), N-(caproyl-4-hydroxyprolinol (Hyp-C6), N-(acetyl-4-hydroxyprolinol (Hyp-NHAc), thymidine-2'-O-deoxythymidine (ether), N-(aminocaproyl)-4-hydroxyprolinol (Hyp-C6-amino), 2-docosanoyl-uridine-3"-phosphate, inverted base dT(idT) and others. Disclosure of this modification can be found in PCT Publication No. WO 2011/005861.

Other modifications of a RNAi agent of the disclosure include a 5' phosphate or 5' phosphate mimic, e.g., a 5'-terminal phosphate or phosphate mimic on the antisense strand of a RNAi agent. Suitable phosphate mimics are disclosed in, for example US 2012/0157511, the contents of which are incorporated herein by reference for the methods provided therein.

iRNA Motifs

In certain aspects of the disclosure, the double-stranded RNAi agents of the disclosure include agents with chemical modifications as disclosed, for example, in WO 2013/075035, the contents of which are incorporated herein by reference for the methods provided therein. As shown herein and in WO 2013/075035, a superior result may be obtained by introducing one or more motifs of three identical modifications on three consecutive nucleotides into a sense strand or antisense strand of an RNAi agent, particularly at or near the cleavage site. In some embodiments, the sense strand and antisense strand of the RNAi agent may otherwise be completely modified. The introduction of these motifs interrupts the modification pattern, if present, of the sense or antisense strand. The RNAi agent may be optionally conjugated with a lipophilic moiety or ligand, e.g., a C16 moiety or ligand, for instance on the sense strand. The RNAi agent may be optionally modified with a (S)-glycol nucleic acid (GNA) modification, for instance on one or more residues of the antisense strand. The resulting RNAi agents present superior gene silencing activity.

In some embodiments, the sense strand sequence may be represented by formula (I):

5'np-Na-(X X X)i-Nb-Y Y Y-Nb-(Z Z Z)j-Na-nq 3' (I)

wherein:

i and j are each independently 0 or 1;

p and q are each independently 0-6;

each Na independently represents an oligonucleotide sequence comprising 0-25 modified nucleotides, each sequence comprising at least two differently modified nucleotides;

each Nb independently represents an oligonucleotide sequence comprising 0-10 modified nucleotides;

each np and nq independently represent an overhang nucleotide;

wherein Nb and Y do not have the same modification; and

XXX, YYY and ZZZ each independently represent one motif of three identical modifications on three consecutive nucleotides. In some embodiments, YYY is all 2'-F modified nucleotides.

In some embodiments, the Na and/or Nb comprise modifications of alternating pattern.

In some embodiments, the YYY motif occurs at or near the cleavage site of the sense strand. For example, when the RNAi agent has a duplex region of 17-23 nucleotides in length, the YYY motif can occur at or the vicinity of the cleavage site (e.g.: can occur at positions 6, 7, 8; 7, 8, 9; 8, 9, 10; 9, 10, 11; 10, 11,12 or 11, 12, 13) of the sense strand, the count starting from the $1^{st}$ nucleotide, from the 5'-end; or optionally, the count starting at the 1st paired nucleotide within the duplex region, from the 5'-end.

In some embodiments, i is 1 and j is 0, or i is 0 and j is 1, or both i and j are 1. The sense strand can therefore be represented by the following formulas:

5'np-Na-YYY-Nb-ZZZ-Na-nq 3' (Ib);

5'np-Na-XXX-Nb-YYY-Na-nq 3' (Ic); or

5'np-Na-XXX-Nb-YYY-Nb-ZZZ-Na-nq 3' (Id).

When the sense strand is represented by formula (Ib), Nb represents an oligonucleotide sequence comprising 0-10, 0-7, 0-5, 0-4, 0-2 or 0 modified nucleotides. Each Na independently can represent an oligonucleotide sequence comprising 2-20, 2-15, or 2-10 modified nucleotides.

When the sense strand is represented as formula (Ic), Nb represents an oligonucleotide sequence comprising 0-10, 0-7, 0-5, 0-4, 0-2 or 0 modified nucleotides. Each Na can independently represent an oligonucleotide sequence comprising 2-20, 2-15, or 2-10 modified nucleotides.

When the sense strand is represented as formula (Id), each Nb independently represents an oligonucleotide sequence comprising 0-10, 0-7, 0-5, 0-4, 0-2 or 0 modified nucleotides. In some embodiments, Nb is 0, 1, 2, 3, 4, 5 or 6. Each Na can independently represent an oligonucleotide sequence comprising 2-20, 2-15, or 2-10 modified nucleotides.

Each of X, Y and Z may be the same or different from each other.

In other embodiments, i is 0 and j is 0, and the sense strand may be represented by the formula:

$5'n_p\text{-}N_a\text{-}YYY\text{-}N_a\text{-}n_q\ 3'$ (Ia).

When the sense strand is represented by formula (Ia), each $N_a$ independently can represent an oligonucleotide sequence comprising 2-20, 2-15, or 2-10 modified nucleotides.

In some embodiments, the antisense strand sequence of the RNAi may be represented by formula (II):

$5'n_{q'}\text{-}N_a'\text{-}(Z'Z'Z')_k\text{-}N_b'\text{-}Y'Y'Y'\text{-}N_b'\text{-}(X'X'X')_l\text{-}N_a'\text{-}n_p'3'$ (II)

wherein:

k and l are each independently 0 or 1;

p' and q' are each independently 0-6;

each Na' independently represents an oligonucleotide sequence comprising 0-25 modified nucleotides, each sequence comprising at least two differently modified nucleotides;

each Nb' independently represents an oligonucleotide sequence comprising 0-10 modified nucleotides;

each $n_p'$ and $n_q'$ independently represent an overhang nucleotide;

wherein $N_b'$ and Y' do not have the same modification; and

X'X'X', Y'Y'Y', and Z'Z'Z' each independently represent one of three identical modification on three consecutive nucleotides.

In some embodiments, the $N_a'$ and/or $N_b'$ comprise modification of alternating pattern.

The Y'Y'Y' motif occurs at or near the cleavage site of the antisense strand. For example, when the RNAi agent has a duplex region of 17-23 nucleotides in length, the Y'Y'Y' motif can occur at positions 9, 10, 11; 10, 11, 12; 11, 12, 13; 12, 13, 14; or 13, 14, 15 of the antisense strand, with the count starting from the $1^{st}$ nucleotide, from the 5'-end; or optionally, the count starting at the $1^{st}$ paired nucleotide within the duplex region, from the 5'-end. In some embodiments, the Y'Y'Y' motif occurs at positions 11, 12, 13.

In some embodiments, Y'Y'Y' motif is all 2'-Ome modified nucleotides.

In on embodiment, k is 1 and l is 0, or k is 0 and l is 1, or both k and l are 1.

The antisense strand can therefore be represented by the following formulas:

$5'n_q'\text{-}N_a'\text{-}Z'Z'Z'\text{-}Nb'\text{-}Y'Y'Y'\text{-}N_a'\text{-}n_p'3'$ (IIb);

$5'n_q'\text{-}N_a'\text{-}Y'Y'Y'\text{-}Nb'\text{-}X'X'X'\text{-}n_p'3'$ (IIc); or $5'n_q'\text{-}Na'\text{-}Z'Z'Z'\text{-}Ne'\text{-}Y'Y'Y'\text{-}Nb'\text{-}X'X'X'\text{-}N_a'\text{-}n_p'3'$ (IId).

When the antisense strand is represented by formula (IIb), Nb' represents an oligonucleotide sequence comprising 0-10, 0-7, 0-5, 0-4, 0-2 or 0 modified nucleotides. Each Na' independently represents an oligonucleotide sequence comprising 2-20, 2-15, or 2-10 modified nucleotides.

When the antisense strand is represented as formula (IId), each Nb' independently represents an oligonucleotide sequence comprising 0-10, 0-7, 0-5, 0-4, 0-2 or 0 modified nucleotides. Each Na' independently represents an oligonucleotide sequence comprising 2-20, 2-15, or 2-10 modified nucleotides. In some embodiments, Nb is 0, 1, 2, 3, 4, 5 or 6.

In other embodiments, k is 0 and l is 0 and the antisense strand may be represented by the formula:

5'np'-Na'-Y'Y'Y'-Na'-nq'3' (Ia).

When the antisense strand is represented as formula (IIa), each Na' independently represents an oligonucleotide sequence comprising 2-20, 2-15, or 2-10 modified nucleotides.

Each of X', Y' and Z' may be the same or different from each other.

Each nucleotide of the sense strand and antisense strand may be independently modified with LNA, HNA, CeNA, GNA, 2'-methoxyethyl, 2'-O-methyl, 2'-O-allyl, 2'-C-allyl, 2'-hydroxyl, or 2'-fluoro. For example, each nucleotide of the sense strand and antisense strand is independently modified with 2'-O-methyl or 2'-fluoro. Each X, Y, Z, X', Y' and Z', in particular, may represent a 2'-O-methyl modification or a 2'-fluoro modification.

In some embodiments, the sense strand of the RNAi agent may contain YYY motif occurring at 9, 10 and 11 positions of the strand when the duplex region is 21 nt, the count starting from the $1^{st}$ nucleotide from the 5'-end, or optionally, the count starting at the $1^{st}$ paired nucleotide within the duplex region, from the 5'-end; and Y represents 2'-F modification. The sense strand may additionally contain XXX motif or ZZZ motifs as wing modifications at the opposite end of the duplex region; and XXX and ZZZ each independently represents a 2'-OMe modification or 2'-F modification.

In some embodiments the antisense strand may Y'Y'Y' motif occurring at positions 11, 12, 13 of the strand, the count starting from the $1^{st}$ nucleotide from the 5'-end, or optionally, the count starting at the $1^{st}$ paired nucleotide within the duplex region, from the 5'-end; and Y' represents 2'-O-methyl modification. The antisense strand may additionally contain X'X'X' motif or Z'Z'Z' motifs as wing modifications at the opposite end of the duplex region; and X'X'X' and Z'Z'Z' each independently represents a 2'-OMe modification or 2'-F modification.

The sense strand represented by any one of the above formulas (Ia), (Ib), (Ic), and (Id) forms a duplex with an antisense strand being represented by any one of formulas (IIa), (IIb), (IIc), and (IId), respectively.

Accordingly, certain RNAi agents for use in the methods of the disclosure may comprise a sense strand and an antisense strand, each strand having 14 to 30 nucleotides, the RNAi duplex represented by formula (III):

sense: 5'$n_p$-$N_a$-(XXX)i-$N_b$-YYY-$N_b$-(ZZZ)j-$N_a$-$n_q$ 3' antisense: 3'$n_p$'-Na'-(X'X'X')k-$N_b$'-Y'Y'Y'-$N_b$'-(Z'Z'Z')$_l$-$N_a$'-$n_q$'5' (III)

wherein, j, k, and l are each independently 0 or 1;

p, p', q, and q' are each independently 0-6;

each $N_a$ and $N_a$' independently represents an oligonucleotide sequence comprising 0-25 modified nucleotides, each sequence comprising at least two differently modified nucleotides;

each $N_b$ and $N_b$' independently represents an oligonucleotide sequence comprising 0-10 modified nucleotides; wherein each $n_p$', $n_p$, $n_q$', and $n_q$, each of which may or may not be present independently represents an overhang nucleotide; and XXX, YYY, ZZZ, X'X'X', Y'Y'Y', and Z'Z'Z' each independently represent one motif of three identical modification on three consecutive nucleotides.

In some embodiments, i is 0 and j is 0; or i is 1 and j is 0; or i is 0 and j is 1; or both i and j are 0; or both i and j are 1. In some embodiments, k is 0 and l is 0; or k is 1 and l is 0; k is 0 and l is 1; or both k and l are 0; or both k and l are 1.

Exemplary combinations of the sense strand and antisense strand forming a RNAi duplex include the formulas below:

5'$n_p$-$N_a$-Y Y Y-$N_a$-$n_q$ 3'

3'$n_p$'-$N_a$'-Y'Y'Y'-$N_a$'$n_q$'5' (IIIa)

5'$n_p$-$N_a$'-Y Y Y-$N_b$-ZZZ-$N_a$-$n_q$ 3'

3'$n_p$-$N_a$'-Y'Y'Y'-Nb'-Z'Z'Z'-Na'-nq'5' (IIIb)

5'$n_p$-$N_a$-X X X-$N_b$-Y Y Y-$N_a$-$n_q$ 3'

3'$n_p$-$N_a$'-X'X'X'-$N_b$'-Y'Y'Y'-Na'-$n_q$'5' (IIIc)

5'$n_p$-$N_a$-XXX-$N_b$-Y Y Y-$N_b$-Z Z Z-$N_a$-$n_q$ 3'

3'$n_p$-$N_a$'-X'X'X'-$N_b$'-Y'Y'Y'-$N_b$'-Z'Z'Z'-Na'-$n_q$'5' (IIId)

When the RNAi agent is represented by formula (IIIa), each $N_a$ independently represents an oligonucleotide sequence comprising 2-20, 2-15, or 2-10 modified nucleotides.

When the RNAi agent is represented by formula (IIIb), each Nb independently represents an oligonucleotide sequence comprising 1-10, 1-7, 1-5 or 1-4 modified nucleotides. Each $N_a$ independently represents an oligonucleotide sequence comprising 2-20, 2-15, or 2-10 modified nucleotides.

When the RNAi agent is represented as formula (IIIc), each Nb, Nb' independently represents an oligonucleotide sequence comprising 0-10, 0-7, 0-5, 0-4, 0-2 or 0 modified nucleotides. Each $N_a$ independently represents an oligonucleotide sequence comprising 2-20, 2-15, or 2-10 modified nucleotides.

When the RNAi agent is represented as formula (IIId), each Nb, Nb' independently represents an oligonucleotide sequence comprising 0-10, 0-7, 0-5, 0-4, 0-2 or 0 modified nucleotides. Each $N_a$, $N_a$' independently represents an oligonucleotide sequence comprising 2-20, 2-15, or 2-10 modified nucleotides. Each of $N_a$, $N_a$', $N_b$ and $N_b$' independently comprises modifications of alternating pattern.

Each of X, Y and Z in formulas (III), (IIIa), (IIIb), (IIIc), and (IIId) may be the same or different from each other.

When the RNAi agent is represented by formula (III), (IIIa), (IIIb), (IIIc), and (IIId), at least one of the Y nucleotides may form a base pair with one of the Y' nucleotides. Alternatively, at least two of the Y nucleotides form base pairs with the corresponding Y' nucleotides; or all three of the Y nucleotides all form base pairs with the corresponding Y' nucleotides.

When the RNAi agent is represented by formula (IIIb) or (IIId), at least one of the Z nucleotides may form a base pair with one of the Z' nucleotides. Alternatively, at least two of the Z nucleotides form base pairs with the corresponding Z' nucleotides; or all three of the Z nucleotides all form base pairs with the corresponding Z' nucleotides.

When the RNAi agent is represented as formula (IIIc) or (IIId), at least one of the X nucleotides may form a base pair with one of the X' nucleotides. Alternatively, at least two of the X nucleotides form base pairs with the corresponding X' nucleotides; or all three of the X nucleotides all form base pairs with the corresponding X' nucleotides.

In some embodiments, the modification on the Y nucleotide is different than the modification on the Y' nucleotide, the modification on the Z nucleotide is different than the modification on the Z' nucleotide, and/or the modification on the X nucleotide is different than the modification on the X' nucleotide.

In some embodiments, when the RNAi agent is represented by formula (IIId), the Na modifications are 2'-O-methyl or 2'-fluoro modifications. In some embodiments, when the RNAi agent is represented by formula (IIId), the Na modifications are 2'-O-methyl or 2'-fluoro modifications and np' >0 and at least one np' is linked to a neighboring nucleotide a via phosphorothioate linkage. In some embodiments, when the RNAi agent is represented by formula (IIId), the Na modifications are 2'-O-methyl or 2'-fluoro modifications, np'>0 and at least one np' is linked to a neighboring nucleotide via phosphorothioate linkage, and the sense strand is conjugated to one or more moieties or ligands (e.g., one or more lipophilic moieties, optionally one or more C16 moieties, or one or more GalNAc moieties) attached through a bivalent or trivalent branched linker. In some embodiments, when the RNAi agent is represented by formula (IIId), the Na modifications are 2'-O-methyl or 2'-fluoro modifications, np'>0 and at least one np' is linked to a neighboring nucleotide via phosphorothioate linkage, the sense strand comprises at least one phosphorothioate linkage, and the sense strand is conjugated to one or more moieties or ligands (e.g., one or more lipophilic moieties, optionally one or more C16 moieties, or one or more GalNAc moieties) attached through a bivalent or trivalent branched linker.

In some embodiments, when the RNAi agent is represented by formula (IIIa), the Na modifications are 2'-O-methyl or 2'-fluoro modifications, np'>0 and at least one np' is linked to a neighboring nucleotide via phosphorothioate linkage, the sense strand comprises at least one phosphorothioate linkage, and the sense strand is conjugated to one or more moieties or ligands (e.g., one or more lipophilic moieties, optionally one or more C16 moieties) attached through a bivalent or trivalent branched linker.

In some embodiments, the RNAi agent is a multimer containing at least two duplexes represented by formula (III), (IIIa), (IIIb), (IIIc), and (IIId), wherein the duplexes are connected by a linker. The linker can be cleavable or non-cleavable. Optionally, the multimer further comprises a ligand. Each of the duplexes can target the same gene or two different genes; or each of the duplexes can target same gene at two different target sites.

In some embodiments, the RNAi agent is a multimer containing three, four, five, six or more duplexes represented by formula (III), (IIIa), (IIIb), (IIIc), and (IIId), wherein the duplexes are connected by a linker. The linker can be cleavable or non-cleavable. Optionally, the multimer further comprises a ligand. Each of the duplexes can target the same gene or two different genes; or each of the duplexes can target same gene at two different target sites.

In some embodiments, two RNAi agents represented by formula (III), (IIIa), (IIIb), (IIIc), and (IIId) are linked to each other at the 5' end, and one or both of the 3' ends and are optionally conjugated to a ligand. Each of the agents can target the same gene or two different genes; or each of the agents can target same gene at two different target sites.

Various publications describe multimeric RNAi agents that can be used in the methods of the disclosure. Such publications include WO2007/091269, WO2010/141511, WO2007/117686, WO2009/014887, and WO2011/031520; and U.S. Pat. No. 7,858,769, the contents of each of which are hereby incorporated herein by reference for the methods provided therein. In certain embodiments, the RNAi agents of the disclosure may include GalNAc ligands.

As described in more detail below, the RNAi agent that contains conjugations of one or more carbohydrate moieties to a RNAi agent can optimize one or more properties of the RNAi agent. In many cases, the carbohydrate moiety will be attached to a modified subunit of the RNAi agent. For example, the ribose sugar of one or more ribonucleotide subunits of a dsRNA agent can be replaced with another moiety, e.g., a non-carbohydrate (preferably cyclic) carrier to which is attached a carbohydrate ligand. A ribonucleotide subunit in which the ribose sugar of the subunit has been so replaced is referred to herein as a ribose replacement modification subunit (RRMS). A cyclic carrier may be a carbocyclic ring system, i.e., all ring atoms are carbon atoms, or a heterocyclic ring system, i.e., one or more ring atoms may be a heteroatom, e.g., nitrogen, oxygen, sulfur. The cyclic carrier may be a monocyclic ring system, or may contain two or more rings, e.g. fused rings. The cyclic carrier may be a fully saturated ring system, or it may contain one or more double bonds.

The ligand may be attached to the polynucleotide via a carrier. The carriers include (i) at least one "backbone attachment point," or two "backbone attachment points" and (ii) at least one "tethering attachment point." A "backbone attachment point" as used herein refers to a functional group, e.g. a hydroxyl group, or generally, a bond available for, and that is suitable for incorporation of the carrier into the backbone, e.g., the phosphate, or modified phosphate, e.g., sulfur containing, backbone, of a ribonucleic acid. A "tethering attachment point" (TAP) in some embodiments refers to a constituent ring atom of the cyclic carrier, e.g., a carbon atom or a heteroatom (distinct from an atom which provides a backbone attachment point), that connects a selected moiety. The moiety can be, e.g., a carbohydrate, e.g. monosaccharide, disaccharide, trisaccharide, tetrasaccharide, oligosaccharide, and polysaccharide. Optionally, the selected moiety is connected by an intervening tether to the cyclic carrier. Thus, the cyclic carrier will often include a functional group, e.g., an amino group, or generally, provide a bond, that is suitable for incorporation or tethering of another chemical entity, e.g., a ligand to the constituent ring.

The RNAi agents may be conjugated to a ligand via a carrier, wherein the carrier can be cyclic group or acyclic group. In some embodiments, the cyclic group is selected from pyrrolidinyl, pyrazolinyl, pyrazolidinyl, imidazolinyl, imidazolidinyl, piperidinyl, piperazinyl, [1,3]dioxolane, oxazolidinyl, isoxazolidinyl, morpholinyl, thiazolidinyl, isothiazolidinyl, quinoxalinyl, pyridazinonyl, tetrahydrofuryl and and decalin. In some embodiments, the acyclic group is selected from serinol backbone or diethanolamine backbone.

In certain specific embodiments, the RNAi agent for use in the methods of the disclosure is an agent selected from the group of agents listed in any one of Tables 2A, 2B, 4A, 4B, 5A, 5B, 6A, 6B, 13A, 13B, 14A, 14B, 15A, 15B, 16, 18, and 20. These agents may further comprise a ligand. The ligand can be attached to the sense strand, antisense strand or both strands, at the 3'-end, 5'-end, or both ends. For instance, the ligand may be conjugated to the sense strand, in particular, the 3'-end of the sense strand.

iRNA Conjugates

The iRNA agents disclosed herein can be in the form of conjugates. The conjugate may be attached at any suitable location in the iRNA molecule, e.g., at the 3' end or the 5' end of the sense or the antisense strand. The conjugates are optionally attached via a linker.

In some embodiments, an iRNA agent described herein is chemically linked to one or more ligands, moieties or conjugates, which may confer functionality, e.g., by affecting (e.g., enhancing) the activity, cellular distribution or cellular uptake of the iRNA. Such moieties include but are not limited to lipid moieties such as a cholesterol moiety (Letsinger et al., *Proc. Natl. Acid. Sci. USA,* 1989, 86: 6553-6556), cholic acid (Manoharan et al., *Biorg. Med. Chem. Let.,* 1994, 4:1053-1060), a thioether, e.g., beryl-S-tritylthiol (Manoharan et al., *Ann. N.Y. Acad. Sci.,* 1992, 660:306-309; Manoharan et al., *Biorg. Med. Chem. Let.,* 1993, 3:2765-2770), a thiocholesterol (Oberhauser et al., *Nucl. Acids Res.,* 1992, 20:533-538), an aliphatic chain, e.g., dodecandiol or undecyl residues (Saison-Behmoaras et al., *EMBO J,* 1991, 10:1111-1118; Kabanov et al., *FEBS Lett.,* 1990, 259:327-330; Svinarchuk et al., *Biochimie,* 1993, 75:49-54), a phospholipid, e.g., di-hexadecyl-rac-glycerol or triethyl-ammonium 1,2-di-O-hexadecyl-rac-glycero-3-phosphonate (Manoharan et al., *Tetrahedron Lett.,* 1995, 36:3651-3654; Shea et al., *Nucl. Acids Res.,* 1990, 18:3777-3783), a polyamine or a polyethylene glycol chain (Manoharan et al., *Nucleosides & Nucleotides,* 1995, 14:969-973), or adamantane acetic acid (Manoharan et al., *Tetrahedron Lett.,* 1995, 36:3651-3654), a palmityl moiety (Mishra et al., *Biochim. Biophys. Acta,* 1995, 1264:229-237), or an octadecylamine or hexylamino-carbonyloxycholesterol moiety (Crooke et al., *J. Pharmacol. Exp. Ther.,* 1996, 277:923-937).

In some embodiments, a ligand alters the distribution, targeting or lifetime of an iRNA agent into which it is incorporated. In some embodiments, a ligand provides an enhanced affinity for a selected target, e.g., molecule, cell or cell type, compartment, e.g., a cellular or organ compartment, tissue, organ or region of the body, as, e.g., compared to a species absent such a ligand. Typical ligands will not take part in duplex pairing in a duplexed nucleic acid.

Ligands can include a naturally occurring substance, such as a protein (e.g., human serum albumin (HSA), low-density lipoprotein (LDL), or globulin); carbohydrate (e.g., a dextran, pullulan, chitin, chitosan, inulin, cyclodextrin or hyaluronic acid); or a lipid. The ligand may also be a recombinant or synthetic molecule, such as a synthetic polymer, e.g., a synthetic polyamino acid. Examples of polyamino acids include polyamino acid is a polylysine (PLL), poly L-aspartic acid, poly L-glutamic acid, styrenemaleic acid anhydride copolymer, poly(L-lactide-co-glycolied) copolymer, divinyl ether-maleic anhydride copolymer, N-(2-hydroxypropyl)methacrylamide copolymer (HMPA), polyethylene glycol (PEG), polyvinyl alcohol (PVA), polyurethane, poly(2-ethylacryllic acid), N-isopropylacrylamide polymers, or polyphosphazine. Examples of polyamines include: polyethylenimine, polylysine (PLL), spermine, spermidine, polyamine, pseudopeptide-polyamine, peptidomimetic polyamine, dendrimer polyamine, arginine, amidine, protamine, cationic lipid, cationic porphyrin, quaternary salt of a polyamine, or an α helical peptide.

Ligands can also include targeting groups, e.g., a cell or tissue targeting agent, e.g., a lectin, glycoprotein, lipid or protein, e.g., an antibody, that binds to a specified cell type such as a kidney cell. A targeting group can be a thyrotropin, melanotropin, lectin, glycoprotein, surfactant protein A, Mucin carbohydrate, multivalent lactose, multivalent galactose, N-acetyl-galactosamine, N-acetyl-gulucosamine multivalent mannose, multivalent fucose, glycosylated polyaminoacids, multivalent galactose, transferrin, bisphosphonate, polyglutamate, polyaspartate, a lipid, cholesterol, a steroid, bile acid, folate, vitamin B12, biotin, or an RGD peptide or RGD peptide mimetic.

Other examples of ligands include dyes, intercalating agents (e.g. acridines), cross-linkers (e.g. psoralene, mitomycin C), porphyrins (TPPC4, texaphyrin, Sapphyrin), polycyclic aromatic hydrocarbons (e.g., phenazine, dihydrophenazine), artificial endonucleases (e.g. EDTA), lipophilic molecules, e.g, cholesterol, cholic acid, adamantane acetic acid, 1-pyrene butyric acid, dihydrotestosterone, 1,3-Bis-O (hexadecyl)glycerol, geranyloxyhexyl group, hexadecylglycerol, borneol, menthol, 1,3-propanediol, heptadecyl group, palmitic acid, myristic acid,O3-(oleoyl) lithocholic acid, O3-(oleoyl)cholenic acid, dimethoxytrityl, or phenoxazine) and peptide conjugates (e.g., antennapedia peptide, Tat peptide), alkylating agents, phosphate, amino, mercapto, PEG (e.g., PEG-40K), MPEG, $[MPEG]_2$, polyamino, alkyl, substituted alkyl, radiolabeled markers, enzymes, haptens (e.g. biotin), transport/absorption facilitators (e.g., aspirin, vitamin E, folic acid), synthetic ribonucleases (e.g., imidazole, bisimidazole, histamine, imidazole clusters, acridine-imidazole conjugates, Eu3+ complexes of tetraazamacrocycles), dinitrophenyl, HRP, or AP.

Ligands can be proteins, e.g., glycoproteins, or peptides, e.g., molecules having a specific affinity for a co-ligand, or antibodies e.g., an antibody, that binds to a specified cell type such as a neuron. Ligands may also include hormones and hormone receptors. They can also include non-peptidic species, such as lipids, lectins, carbohydrates, vitamins, cofactors, multivalent lactose, multivalent galactose, N-acetyl-galactosamine, N-acetyl-glucosamine multivalent mannose, or multivalent fucose. The ligand can be, for example, a lipopolysaccharide, an activator of p38 MAP kinase, or an activator of NF-κB.

The ligand can be a substance, e.g., a drug, which can increase the uptake of the iRNA agent into the cell, for example, by disrupting the cell's cytoskeleton, e.g., by disrupting the cell's microtubules, microfilaments, and/or intermediate filaments. The drug can be, for example, taxon, vincristine, vinblastine, cytochalasin, nocodazole, japlakinolide, latrunculin A, phalloidin, swinholide A, indanocine, or myoservin.

In some embodiments, a ligand attached to an iRNA as described herein acts as a pharmacokinetic modulator (PK modulator). PK modulators include lipophiles, bile acids, steroids, phospholipid analogues, peptides, protein binding agents, PEG, vitamins etc. Exemplary PK modulators include, but are not limited to, cholesterol, fatty acids, cholic acid, lithocholic acid, dialkylglycerides, diacylglyceride, phospholipids, sphingolipids, naproxen, ibuprofen, vitamin E, biotin etc. Oligonucleotides that comprise a number of phosphorothioate linkages are also known to bind to serum protein, thus short oligonucleotides, e.g., oligonucleotides of about 5 bases, 10 bases, 15 bases or 20 bases, comprising multiple of phosphorothioate linkages in the backbone are also amenable to the present disclosure as ligands (e.g. as PK modulating ligands). In addition, aptamers that bind serum components (e.g. serum proteins) are also suitable for use as PK modulating ligands in the embodiments described herein.

Ligand-conjugated oligonucleotides of the disclosure may be synthesized by the use of an oligonucleotide that bears a pendant reactive functionality, such as that derived from the attachment of a linking molecule onto the oligonucleotide (described below). This reactive oligonucleotide may be reacted directly with commercially available ligands, ligands that are synthesized bearing any of a variety of protecting groups, or ligands that have a linking moiety attached thereto.

The oligonucleotides used in the conjugates of the present disclosure may be conveniently and routinely made through the well-known technique of solid-phase synthesis. Equipment for such synthesis is sold by several vendors including, for example, Applied Biosystems (Foster City, Calif.). Any other means for such synthesis known in the art may additionally or alternatively be employed. It is also known to use similar techniques to prepare other oligonucleotides, such as the phosphorothioates and alkylated derivatives.

In the ligand-conjugated oligonucleotides and ligand-molecule bearing sequence-specific linked nucleosides of the present disclosure, the oligonucleotides and oligonucleosides may be assembled on a suitable DNA synthesizer utilizing standard nucleotide or nucleoside precursors, or nucleotide or nucleoside conjugate precursors that already bear the linking moiety, ligand-nucleotide or nucleoside-conjugate precursors that already bear the ligand molecule, or non-nucleoside ligand-bearing building blocks.

When using nucleotide-conjugate precursors that already bear a linking moiety, the synthesis of the sequence-specific linked nucleosides is typically completed, and the ligand molecule is then reacted with the linking moiety to form the ligand-conjugated oligonucleotide. In some embodiments, the oligonucleotides or linked nucleosides of the present disclosure are synthesized by an automated synthesizer using phosphoramidites derived from ligand-nucleoside conjugates in addition to the standard phosphoramidites and non-standard phosphoramidites that are commercially available and routinely used in oligonucleotide synthesis.

A. Lipophilic Moieties

In certain embodiments, the lipophilic moiety is an aliphatic, cyclic such as alicyclic, or polycyclic such as polyalicyclic compound, such as a steroid (e.g., sterol) or a linear or branched aliphatic hydrocarbon. The lipophilic moiety may generally comprise a hydrocarbon chain, which may be cyclic or acyclic. The hydrocarbon chain may comprise various substituents or one or more heteroatoms, such as an oxygen or nitrogen atom. Such lipophilic aliphatic moieties include, without limitation, saturated or unsaturated $C_4$-$C_{30}$ hydrocarbon (e.g., $C_6$-$C_{18}$ hydrocarbon), saturated or unsaturated fatty acids, waxes (e.g., monohydric alcohol esters of fatty acids and fatty diamides), terpenes (e.g., $C_{10}$ terpenes, $C_{15}$ sesquiterpenes, $C_{20}$ diterpenes, $C_{30}$ triterpenes, and $C_{40}$ tetraterpenes), and other polyalicyclic hydrocarbons. For instance, the lipophilic moiety may contain a $C_4$-$C_{30}$ hydrocarbon chain (e.g., $C_4$-$C_{30}$ alkyl or alkenyl). In some embodiments the lipophilic moiety contains a saturated or unsaturated $C_6$-$C_{18}$ hydrocarbon chain (e.g., a linear $C_6$-$C_{18}$ alkyl or alkenyl). In some embodiments, the lipophilic moiety contains a saturated or unsaturated C16 hydrocarbon chain (e.g., a linear C16 alkyl or alkenyl).

The lipophilic moiety may be attached to the RNAi agent by any method known in the art, including via a functional grouping already present in the lipophilic moiety or introduced into the RNAi agent, such as a hydroxy group (e.g., —CO—$CH_2$-OH). The functional groups already present in the lipophilic moiety or introduced into the RNAi agent include, but are not limited to, hydroxyl, amine, carboxylic acid, sulfonate, phosphate, thiol, azide, and alkyne.

Conjugation of the RNAi agent and the lipophilic moiety may occur, for example, through formation of an ether or a carboxylic or carbamoyl ester linkage between the hydroxy and an alkyl group R—, an alkanoyl group RCO— or a substituted carbamoyl group RNHCO—. The alkyl group R may be cyclic (e.g., cyclohexyl) or acyclic (e.g., straight-chained or branched; and saturated or unsaturated). Alkyl group R may be a butyl, pentyl, hexyl, heptyl, octyl, nonyl, decyl, undecyl, dodecyl, tridecyl, tetradecyl, pentadecyl, hexadecyl, heptadecyl or octadecyl group, or the like.

In some embodiments, the lipophilic moiety is conjugated to the double-stranded RNAi agent via a linker a linker containing an ether, thioether, urea, carbonate, amine, amide, maleimide-thioether, disulfide, phosphodiester, sulfonamide linkage, a product of a click reaction (e.g., a triazole from the azide-alkyne cycloaddition), or carbamate.

In other embodiments, the lipophilic moiety is a steroid, such as sterol. Steroids are polycyclic compounds containing a perhydro-1,2-cyclopentanophenanthrene ring system. Steroids include, without limitation, bile acids (e.g., cholic acid, deoxycholic acid and dehydrocholic acid), cortisone, digoxigenin, testosterone, cholesterol, and cationic steroids, such as cortisone. A "cholesterol derivative" refers to a compound derived from cholesterol, for example by substitution, addition or removal of substituents.

In other embodiments, the lipophilic moiety is an aromatic moiety. In this context, the term "aromatic" refers broadly to mono- and polyaromatic hydrocarbons. Aromatic groups include, without limitation, $C_6$-$C_{14}$ aryl moieties comprising one to three aromatic rings, which may be optionally substituted; "aralkyl" or "arylalkyl" groups comprising an aryl group covalently linked to an alkyl group, either of which may independently be optionally substituted or unsubstituted; and "heteroaryl" groups. As used herein, the term "heteroaryl" refers to groups having 5 to 14 ring atoms, e.g., 5, 6, 9, or 10 ring atoms; having 6, 10, or 14π electrons shared in a cyclic array, and having, in addition to carbon atoms, one to about three heteroatoms selected from the group consisting of nitrogen (N), oxygen (O), and sulfur (S).

As employed herein, a "substituted" alkyl, cycloalkyl, aryl, heteroaryl, or heterocyclic group is one having one to about four, one to about three, or one or two, non-hydrogen substituents. Suitable substituents include, without limitation, halo, hydroxy, nitro, haloalkyl, alkyl, alkaryl, aryl, aralkyl, alkoxy, aryloxy, amino, acylamino, alkylcarbamoyl, arylcarbamoyl, aminoalkyl, alkoxycarbonyl, carboxy, hydroxyalkyl, alkanesulfonyl, arenesulfonyl, alkanesulfonamido, arenesulfonamido, aralkylsulfonamido, alkylcarbonyl, acyloxy, cyano, and ureido groups.

In some embodiments, the lipophilic moiety is an aralkyl group, e.g., a 2-arylpropanoyl moiety. The structural features of the aralkyl group are selected so that the lipophilic moiety will bind to at least one protein in vivo. In certain embodiments, the structural features of the aralkyl group are selected so that the lipophilic moiety binds to serum, vascular, or cellular proteins. In certain embodiments, the structural features of the aralkyl group promote binding to albumin, an immunoglobulin, a lipoprotein, α-2-macroglubulin, or α-1-glycoprotein.

In certain embodiments, the ligand is naproxen or a structural derivative of naproxen. Procedures for the synthesis of naproxen can be found in U.S. Pat. Nos. 3,904,682 and 4,009,197, which are hereby incorporated by reference in their entirety. Naproxen has the chemical name (S)-6-Methoxy-α-methyl-2-naphthaleneacetic acid and the structure is

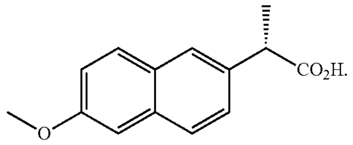 [SMILES: COc1ccc2cc([C@H](C)C(=O)O)ccc2c1]

In certain embodiments, the ligand is ibuprofen or a structural derivative of ibuprofen. Procedures for the synthesis of ibuprofen can be found in U.S. Pat. No. 3,228,831, which is incorporated herein by reference for the methods provided therein. The structure of ibuprofen is

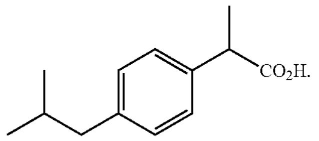

Additional exemplary aralkyl groups are illustrated in U.S. Pat. No. 7,626,014, which is incorporated herein by reference for the methods provided therein.

In other embodiments, suitable lipophilic moieties include lipid, cholesterol, retinoic acid, cholic acid, adamantane acetic acid, 1-pyrene butyric acid, dihydrotestosterone, 1,3-bis-O(hexadecyl)glycerol, geranyloxyhexyanol, hexadecylglycerol, borneol, menthol, 1,3-propanediol, heptadecyl group, palmitic acid, myristic acid, O3-(oleoyl) lithocholic acid, O3-(oleoyl)cholenic acid, ibuprofen, naproxen, dimethoxytrityl, or phenoxazine.

In certain embodiments, more than one lipophilic moiety can be incorporated into the double-strand RNAi agent, particularly when the lipophilic moiety has a low lipophilicity or hydrophobicity. In some embodiments, two or more lipophilic moieties are incorporated into the same strand of the double-strand RNAi agent. In some embodiments, each strand of the double-strand RNAi agent has one or more lipophilic moieties incorporated. In some embodiments, two or more lipophilic moieties are incorporated into the same position (i.e., the same nucleobase, same sugar moiety, or same internucleosidic linkage) of the double-strand RNAi agent. This can be achieved by, e.g., conjugating the two or more lipophilic moieties via a carrier, or conjugating the two or more lipophilic moieties via a branched linker, or conjugating the two or more lipophilic moieties via one or more linkers, with one or more linkers linking the lipophilic moieties consecutively.

The lipophilic moiety may be conjugated to the RNAi agent via a direct attachment to the ribosugar of the RNAi agent. Alternatively, the lipophilic moiety may be conjugated to the double-strand RNAi agent via a linker or a carrier.

In certain embodiments, the lipophilic moiety may be conjugated to the RNAi agent via one or more linkers (tethers).

In some embodiments, the lipophilic moiety is conjugated to the double-stranded RNAi agent via a linker containing an ether, thioether, urea, carbonate, amine, amide, maleimide-thioether, disulfide, phosphodiester, sulfonamide linkage, a product of a click reaction (e.g., a triazole from the azide-alkyne cycloaddition), or carbamate.

B. Lipid Conjugates

In some embodiments, the ligand is a lipid or lipid-based molecule. Such a lipid or lipid-based molecule can typically bind a serum protein, such as human serum albumin (HSA). An HSA binding ligand allows for vascular distribution of the conjugate to a target tissue. For example, the target tissue can be the central nervous system (CNS), e.g., brain and/or the spine, e.g., the dorsal root ganglion. Other molecules that can bind HSA can also be used as ligands. For example, neproxin or aspirin can be used. A lipid or lipid-based ligand can (a) increase resistance to degradation of the conjugate, (b) increase targeting or transport into a target cell or cell membrane, and/or (c) can be used to adjust binding to a serum protein, e.g., HSA.

A lipid-based ligand can be used to modulate, e.g., control (e.g., inhibit) the binding of the conjugate to a target tissue. For example, a lipid or lipid-based ligand that binds to HSA more strongly will be less likely to be targeted to the kidney and therefore less likely to be cleared from the body. A lipid or lipid-based ligand that binds to HSA less strongly can be used to target the conjugate to the kidney.

In some embodiments, the lipid-based ligand binds HSA. For example, the ligand can bind HSA with a sufficient affinity such that distribution of the conjugate to a non-kidney tissue is enhanced. However, the affinity is typically not so strong that the HSA-ligand binding cannot be reversed.

In some embodiments, the lipid-based ligand binds HSA weakly or not at all, such that distribution of the conjugate to the kidney is enhanced. Other moieties that target to kidney cells can also be used in place of or in addition to the lipid-based ligand.

In other embodiments, the ligand is a moiety, e.g., a vitamin, which is taken up by a target cell, e.g., a proliferating cell. These are particularly useful for treating disorders characterized by unwanted cell proliferation, e.g., of the malignant or non-malignant type, e.g., cancer cells. Exemplary vitamins include vitamin A, E, and K. Other exemplary vitamins include are B vitamin, e.g., folic acid, B12, riboflavin, biotin, pyridoxal or other vitamins or nutrients taken up by cancer cells. Also included are HSA and low-density lipoprotein (LDL).

Cell Permeation Agents

In other embodiments, the ligand is a cell-permeation agent, such as a helical cell-permeation agent. In some embodiments, the agent is amphipathic. An exemplary agent is a peptide such as tat or antennopedia. If the agent is a peptide, it can be modified, including a peptidylmimetic, invertomers, non-peptide or pseudo-peptide linkages, and use of D-amino acids. The helical agent is typically an α-helical agent, and can have a lipophilic and a lipophobic phase.

The ligand can be a peptide or peptidomimetic. A peptidomimetic (also referred to herein as an oligopeptidomimetic) is a molecule capable of folding into a defined three-dimensional structure similar to a natural peptide. The attachment of peptide and peptidomimetics to iRNA agents can affect pharmacokinetic distribution of the iRNA, such as by enhancing cellular recognition and absorption. The peptide or peptidomimetic moiety can be about 5-50 amino acids long, e.g., about 5, 10, 15, 20, 25, 30, 35, 40, 45, or 50 amino acids long.

A peptide or peptidomimetic can be, for example, a cell permeation peptide, cationic peptide, amphipathic peptide, or hydrophobic peptide (e.g., consisting primarily of Tyr, Trp or Phe). The peptide moiety can be a dendrimer peptide, constrained peptide or crosslinked peptide. In another alternative, the peptide moiety can include a hydrophobic membrane translocation sequence (MTS). An exemplary hydrophobic MTS-containing peptide is RFGF having the amino acid sequence AAVALLPAVLLALLAP (SEQ ID NO: 3699). An RFGF analogue (e.g., amino acid sequence AALLPVLLAAP (SEQ ID NO: 3700)) containing a hydrophobic MTS can also be a targeting moiety. The peptide moiety can be a "delivery" peptide, which can carry large polar molecules including peptides, oligonucleotides, and protein across cell membranes. For example, sequences from the HIV Tat protein (GRKKRRQRRRPPQ (SEQ ID NO:3701)) and the *Drosophila* Antennapedia protein (RQIKIWFQNRRMKWKK (SEQ ID NO: 3702)) have been found to be capable of functioning as delivery peptides. A peptide or peptidomimetic can be encoded by a random sequence of DNA, such as a peptide identified from a phage-display library, or one-bead-one-compound (OBOC) combinatorial library (Lam et al., *Nature,* 354:82-84, 1991). Typically, the peptide or peptidomimetic tethered to a dsRNA agent via an incorporated monomer unit is a cell targeting peptide such as an arginine-glycine-aspartic acid (RGD)-peptide, or RGD mimic A peptide moiety can range in length from about 5 amino acids to about 40 amino acids. The peptide moieties can have a structural modification, such as to increase stability or direct conformational properties. Any of the structural modifications described below can be utilized.

An RGD peptide for use in the compositions and methods of the disclosure may be linear or cyclic, and may be modified, e.g., glycosylated or methylated, to facilitate targeting to a specific tissue(s). RGD-containing peptides and peptidomimetics may include D-amino acids, as well as synthetic RGD mimics. In addition to RGD, one can use other moieties that target the integrin ligand. In some embodiments, conjugates of this ligand target PECAM-1 or VEGF.

An RGD peptide moiety can be used to target a particular cell type, e.g., a tumor cell, such as an endothelial tumor cell or a breast cancer tumor cell (Zitzmann et al., *Cancer Res.,* 62:5139-43, 2002). An RGD peptide can facilitate targeting of an dsRNA agent to tumors of a variety of other tissues, including the lung, kidney, spleen, or liver (Aoki et al., *Cancer Gene Therapy* 8:783-787, 2001). Typically, the RGD peptide will facilitate targeting of an iRNA agent to the kidney. The RGD peptide can be linear or cyclic, and can be modified, e.g., glycosylated or methylated to facilitate targeting to specific tissues. For example, a glycosylated RGD peptide can deliver an iRNA agent to a tumor cell expressing $\alpha_V\beta_3$ (Haubner et al., *Jour. Nucl. Med.,* 42:326-336, 2001).

A "cell permeation peptide" is capable of permeating a cell, e.g., a microbial cell, such as a bacterial or fungal cell, or a mammalian cell, such as a human cell. A microbial cell-permeating peptide can be, for example, an α-helical linear peptide (e.g., LL-37 or Ceropin P1), a disulfide bond-containing peptide (e.g., α-defensin, β-defensin or bactenecin), or a peptide containing only one or two dominating amino acids (e.g., PR-39 or indolicidin). A cell permeation peptide can also include a nuclear localization signal (NLS). For example, a cell permeation peptide can be a bipartite amphipathic peptide, such as MPG, which is derived from the fusion peptide domain of HIV-1 gp41 and the NLS of SV40 large T antigen (Simeoni et al., *Nucl. Acids Res.* 31:2717-2724, 2003).

Carbohydrate Conjugates and Ligands

In some embodiments of the compositions and methods of the disclosure, an iRNA oligonucleotide further comprises a carbohydrate. The carbohydrate conjugated iRNA are advantageous for the in vivo delivery of nucleic acids, as well as compositions suitable for in vivo therapeutic use, as described herein. As used herein, "carbohydrate" refers to a compound which is either a carbohydrate per se made up of one or more monosaccharide units having at least 6 carbon atoms (which can be linear, branched or cyclic) with an oxygen, nitrogen or sulfur atom bonded to each carbon atom; or a compound having as a part thereof a carbohydrate moiety made up of one or more monosaccharide units each having at least six carbon atoms (which can be linear, branched or cyclic), with an oxygen, nitrogen or sulfur atom bonded to each carbon atom. Representative carbohydrates include the sugars (mono-, di-, tri- and oligosaccharides containing from about 4, 5, 6, 7, 8, or 9 monosaccharide units), and polysaccharides such as starches, glycogen, cellulose and polysaccharide gums. Specific monosaccharides include C5 and above (e.g., C5, C6, C7, or C8) sugars; di- and trisaccharides include sugars having two or three monosaccharide units (e.g., C5, C6, C7, or C8).

In certain embodiments, the compositions and methods of the disclosure include a C16 ligand. In exemplary embodiments, the C16 ligand of the disclosure has the following structure (exemplified here below for a uracil base, yet attachment of the C16 ligand is contemplated for a nucleotide presenting any base (C, G, A, etc.) or possessing any other modification as presented herein, provided that 2' ribo attachment is preserved) and is attached at the 2' position of the ribo within a residue that is so modified:

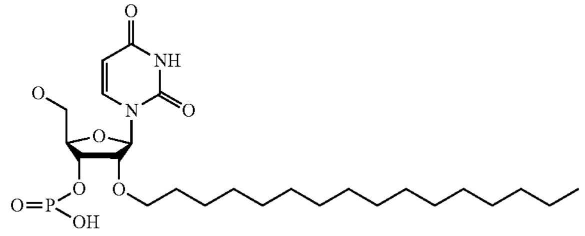

Chemical Formula: $C_{25}H_{43}N_2O_8P$
Exact Mass: 530.2757
Molecular Weight: 530.5913

As shown above, a C16 ligand-modified residue presents a straight chain alkyl at the 2'-ribo position of an exemplary residue (here, a Uracil) that is so modified.

In exemplary embodiments, the C16 ligand of the disclosure can be conjugated to a ribonucleotide residue according to the following structure: possessing any other modification as presented herein, provided that 2'-ribo attachment is preserved) and is attached at the 2'-position of the ribo within a residue that is so modified:

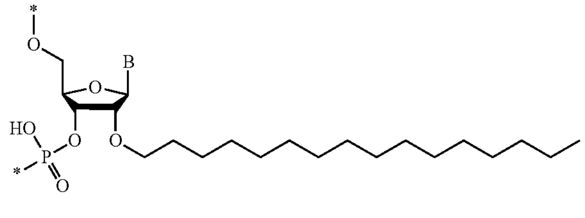

where * denotes a bond to an adjacent nucleotide, and B is a nucleobase or a nucleobase analog, for example, where B is adenine, guanine, cytosine, thymine or uracil.

In some embodiments, a carbohydrate conjugate of a RNAi agent of the instant disclosure further comprises one or more additional ligands as described above, such as, but not limited to, a PK modulator or a cell permeation peptide.

Additional carbohydrate conjugates (and linkers) suitable for use in the present disclosure include those described in WO 2014/179620 and WO 2014/179627, the entire contents of each of which are incorporated herein by reference.

In certain embodiments, the compositions and methods of the disclosure include a 5'-vinyl phosponate (VP) modification of an RNAi agent as described herein. In exemplary embodiments, a 5'-vinyl phosphonate modified nucleotide of the disclosure has the structure of formula:

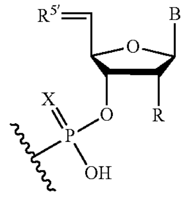

wherein X is O or S;

R is hydrogen, hydroxy, methoxy, fluoro, or $C_{1-20}$alkoxy (e.g., methoxy or n-hexadecyloxy);

$R^{5'}$ is =C(H)—P(O)(OH)$_2$ and the double bond between the C5' carbon and R5' is in the E or Z orientation (e.g., E orientation); and B is a nucleobase or a modified nucleobase, optionally where B is adenine, guanine, cytosine, thymine, or uracil. A vinyl phosponate of the instant disclosure may be attached to either the antisense or the sense strand of a dsRNA of the disclosure. In certain embodiments, a vinyl phosphonate of the instant disclosure is attached to the antisense strand of a dsRNA, optionally at the 5' end of the antisense strand of the dsRNA.

Vinyl phosphate modifications are also contemplated for the compositions and methods of the instant disclosure. An exemplary vinyl phosphate structure is:

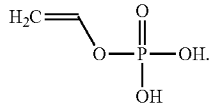

for example, including the preceding structure where $R^{5'}$ is =C(H)—OP(O)(OH)$_2$ and the double bond between the C5' carbon and R5' is in the E or Z orientation (e.g., E orientation).

In some embodiments, a carbohydrate conjugate comprises a monosaccharide. In some embodiments, the monosaccharide is an N-acetylgalactosamine (GalNAc). GalNAc conjugates, which comprise one or more N-acetylgalactosamine (GalNAc) derivatives, are described, for example, in U.S. Pat. No. 8,106,022, the entire content of which is hereby incorporated herein by reference. In some embodiments, the GalNAc conjugate serves as a ligand that targets the iRNA to particular cells. In some embodiments, the GalNAc conjugate targets the iRNA to liver cells, e.g., by serving as a ligand for the asialoglycoprotein receptor of liver cells (e.g., hepatocytes).

In some embodiments, the carbohydrate conjugate comprises one or more GalNAc derivatives. The GalNAc derivatives may be attached via a linker, e.g., a bivalent or trivalent branched linker. In some embodiments the GalNAc conjugate is conjugated to the 3' end of the sense strand. In some embodiments, the GalNAc conjugate is conjugated to the iRNA agent (e.g., to the 3' end of the sense strand) via a linker, e.g., a linker as described herein.

In some embodiments, the GalNAc conjugate is
Formula II
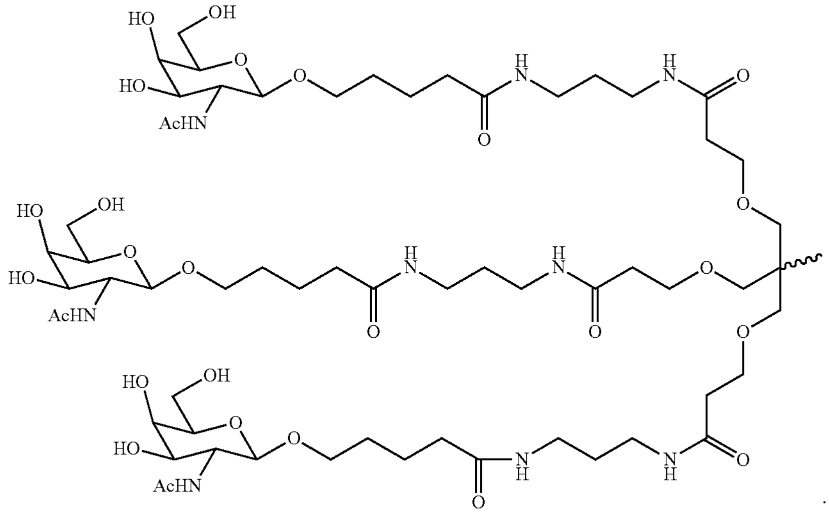
In some embodiments, the RNAi agent is attached to the carbohydrate conjugate via a linker as shown in the following schematic, wherein X is O or S:
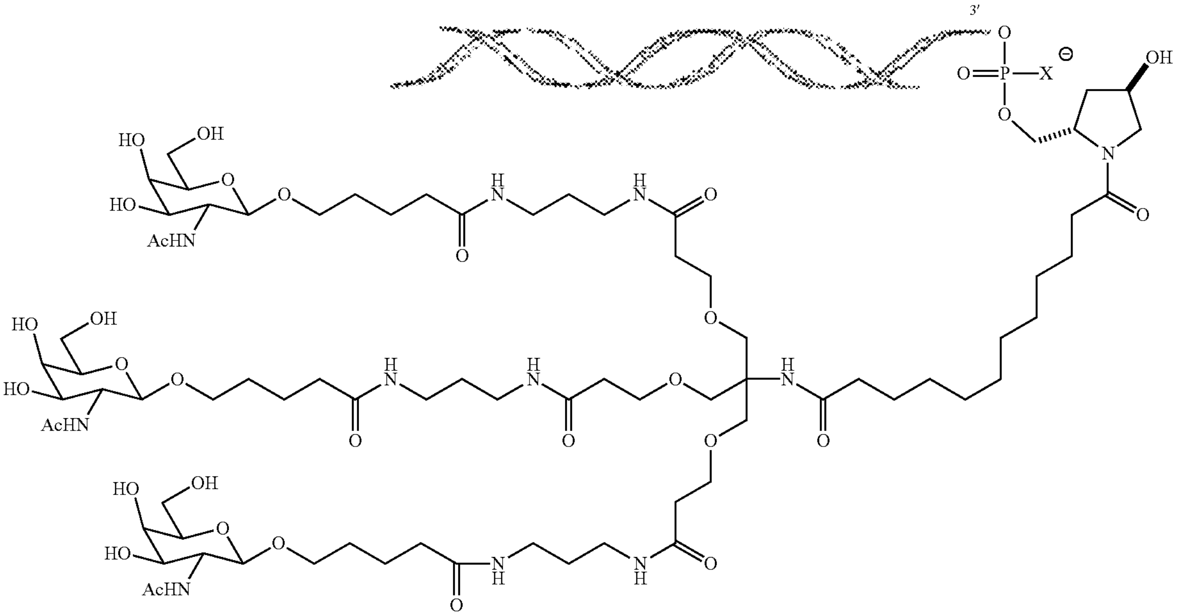

In some embodiments, the RNAi agent is conjugated to L96 as defined in Table 1 and shown below:
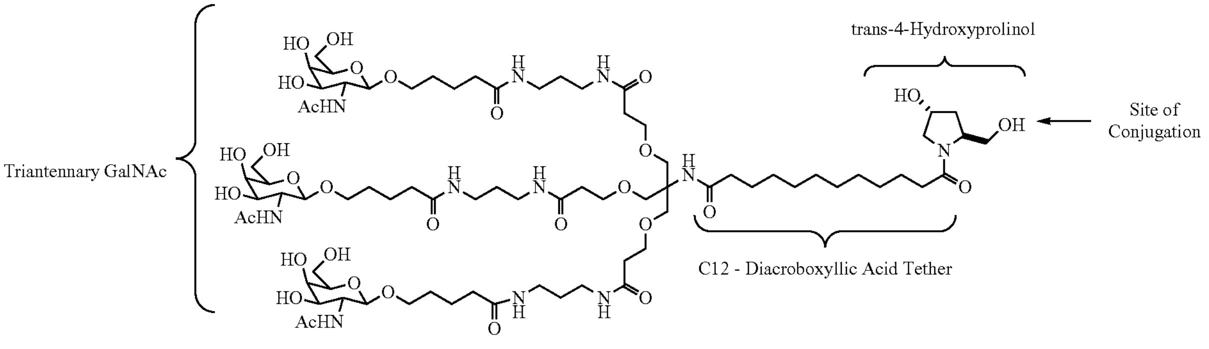
In some embodiments, a carbohydrate conjugate for use in the compositions and methods of the disclosure is selected from the group consisting of:
Formula II
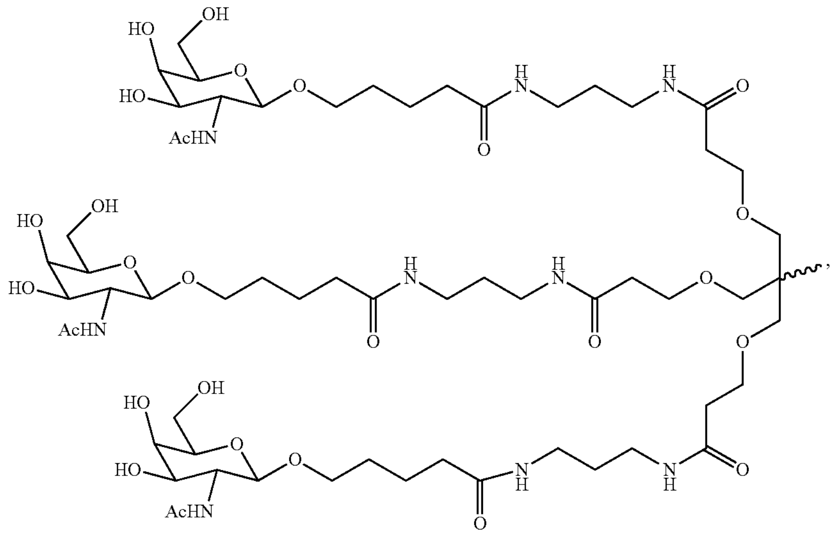
Formula III
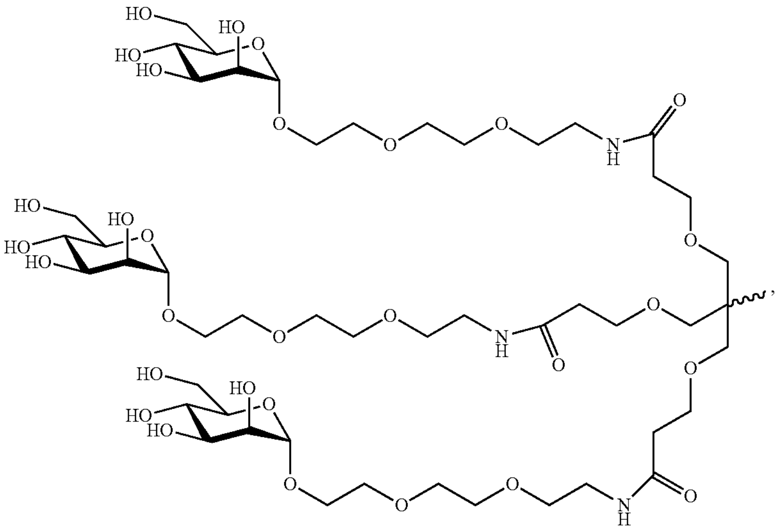

-continued
Formula IV
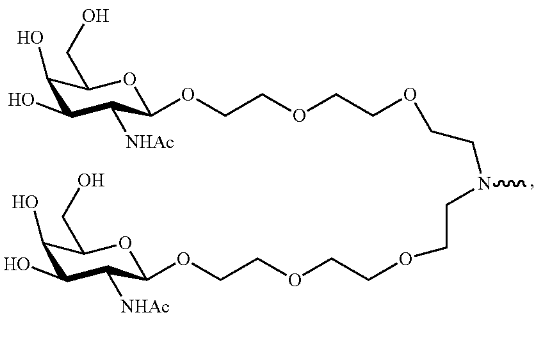
Formula V
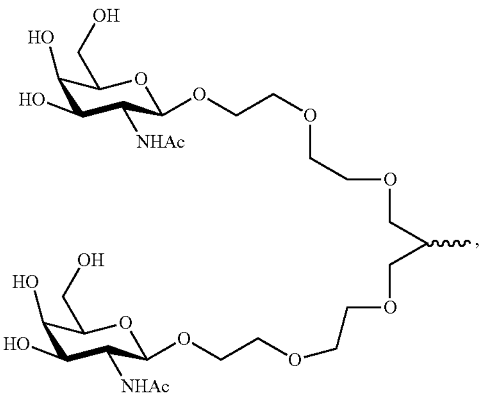
Formula VI
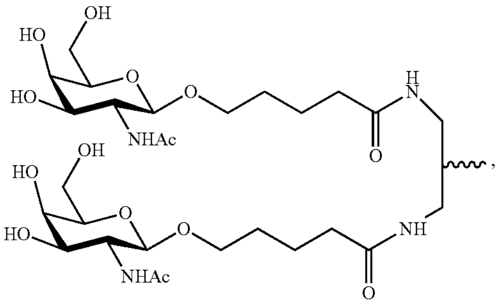
Formula VII
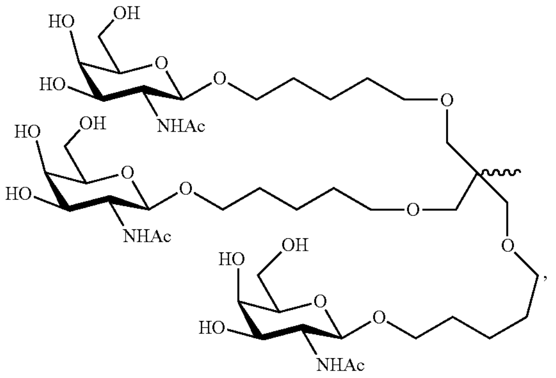
Formula VIII
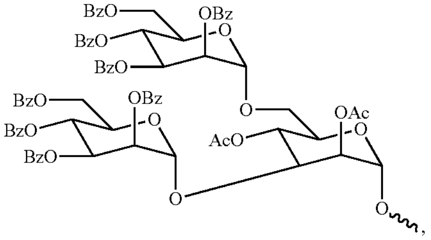
Formula IX
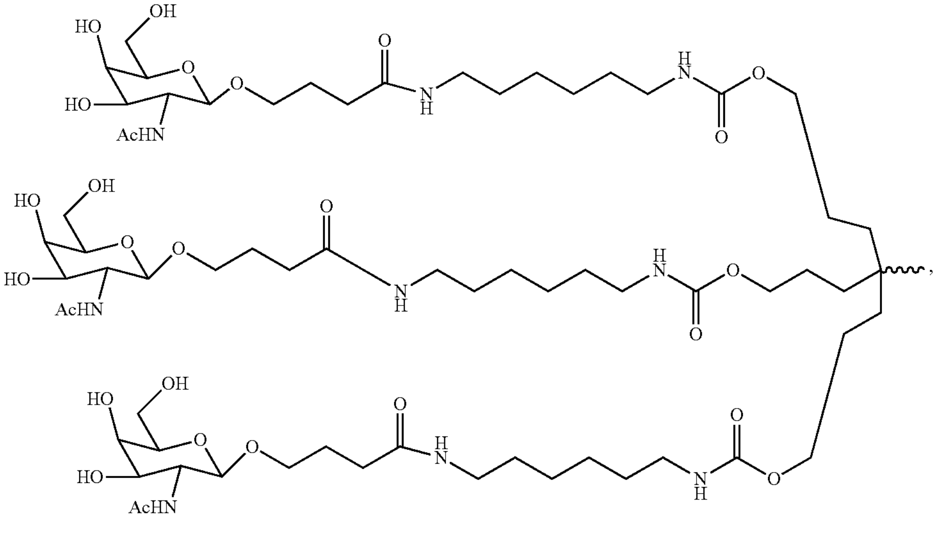

-continued
Formula X
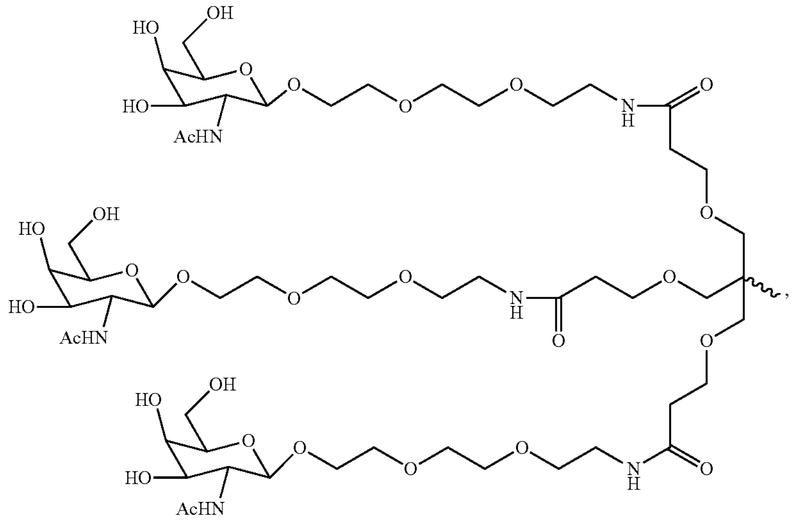
Formula XI
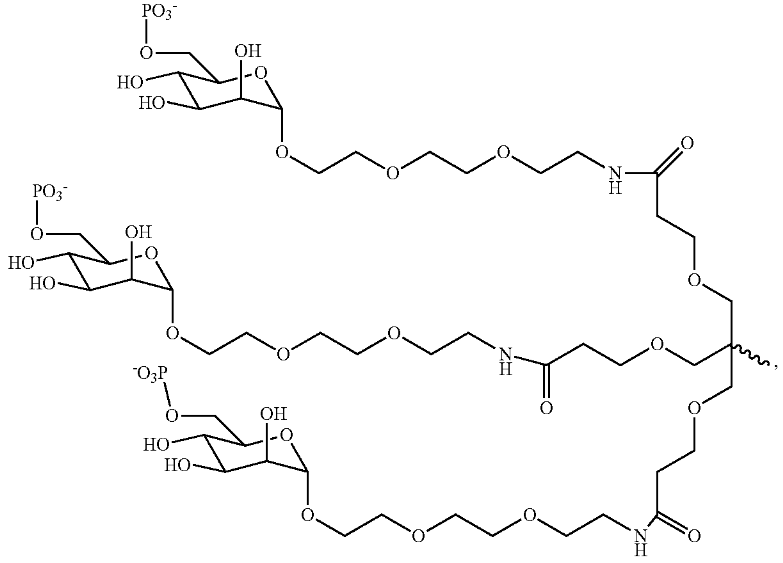

-continued
Formula XII
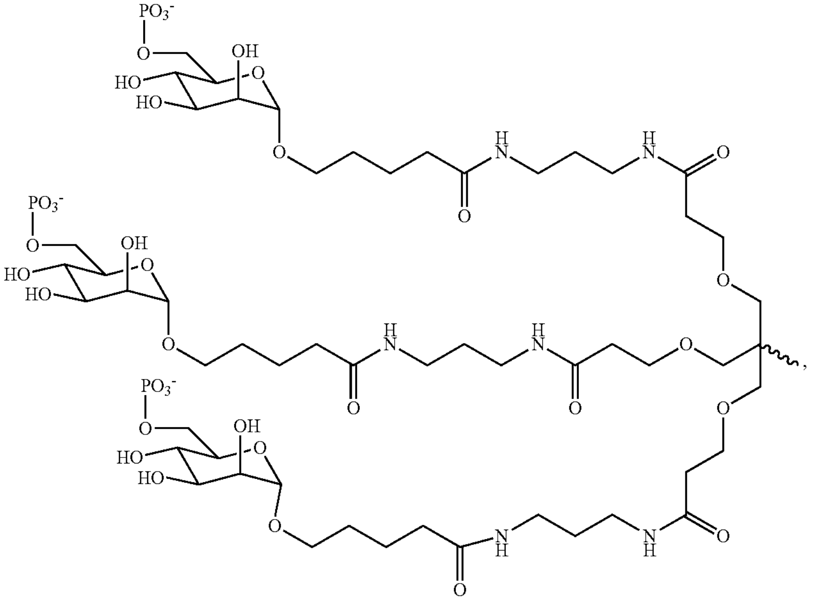
Formula XIII
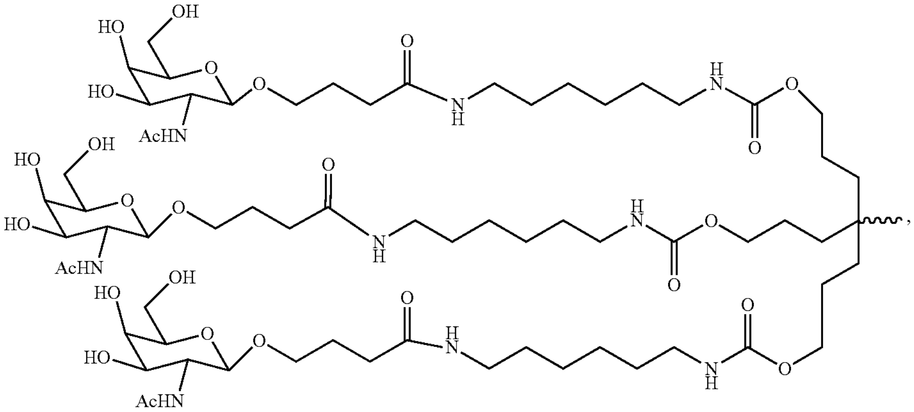
Formula XIV
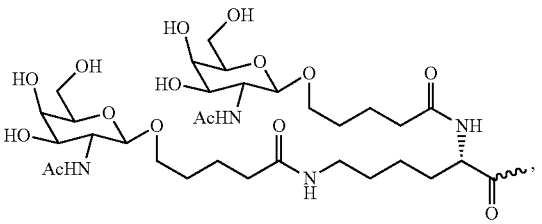
Formula XV
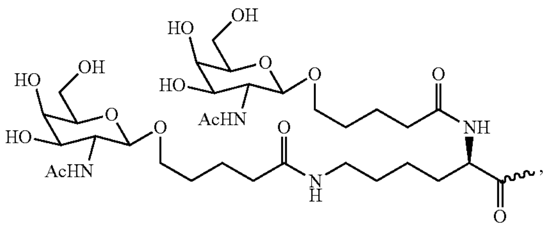
Formula XVI
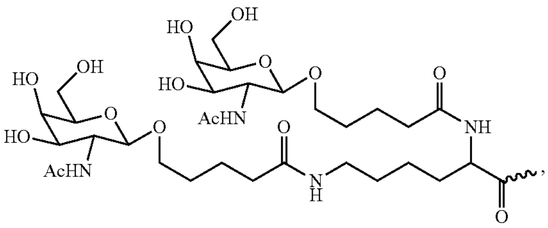
Formula XVII
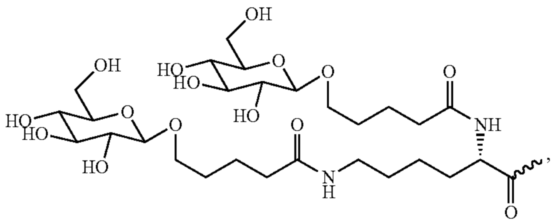

-continued
Formula XVIII
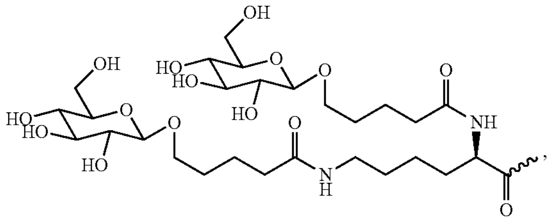
Formula XIX
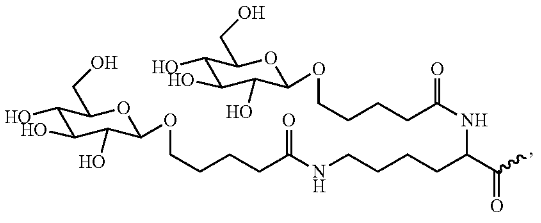
Formula XX
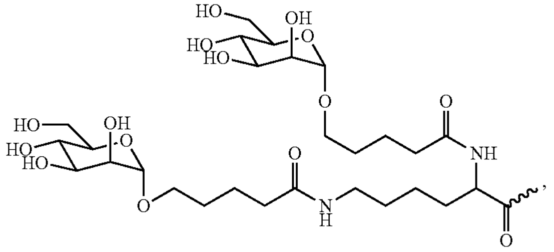
Formula XXI
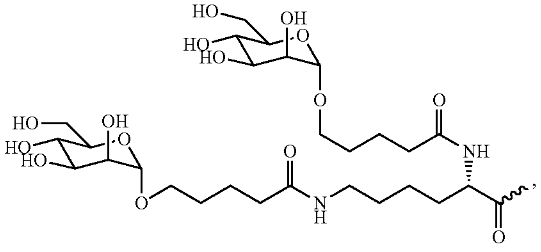
Formula XXII
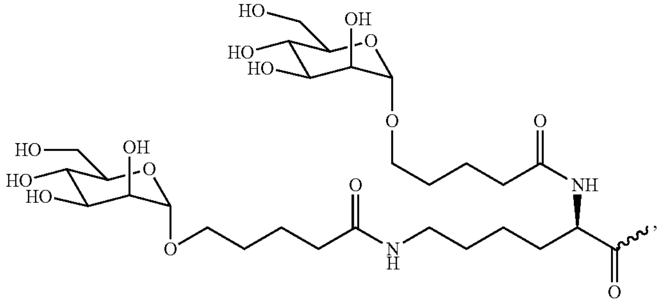

Another representative carbohydrate conjugate for use in the embodiments described herein includes, but is not limited to, (Formula XXIII)

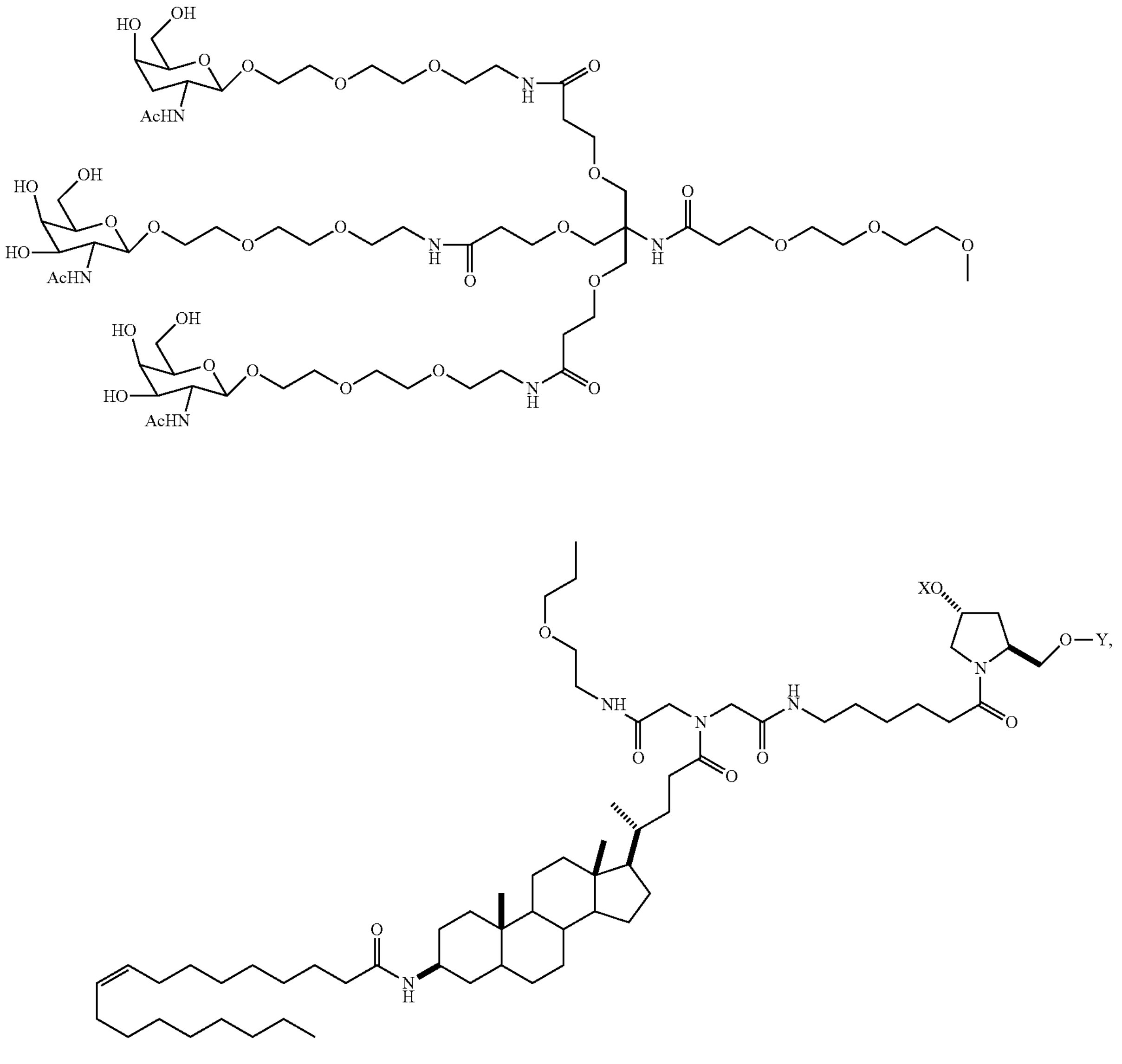

when one of X or Y is an oligonucleotide, the other is a hydrogen.

In some embodiments, the carbohydrate conjugate further comprises one or more additional ligands as described above, such as, but not limited to, a PK modulator and/or a cell permeation peptide.

In some embodiments, an iRNA of the disclosure is conjugated to a carbohydrate through a linker. Non-limiting examples of iRNA carbohydrate conjugates with linkers of the compositions and methods of the disclosure include, but are not limited to, (Formula XXIV)
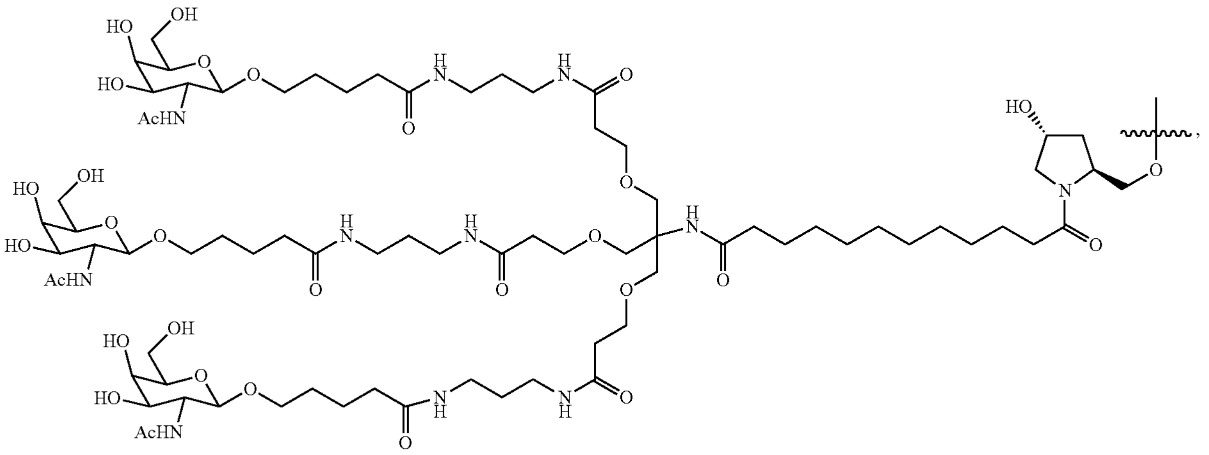
(Formula XXV)
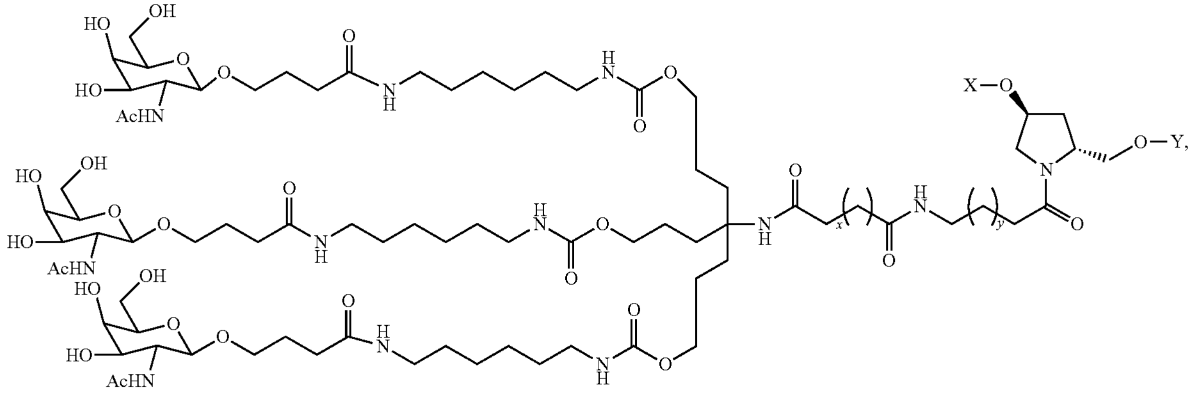
x = 1-30
y = 1-15
(Formula XXVI)
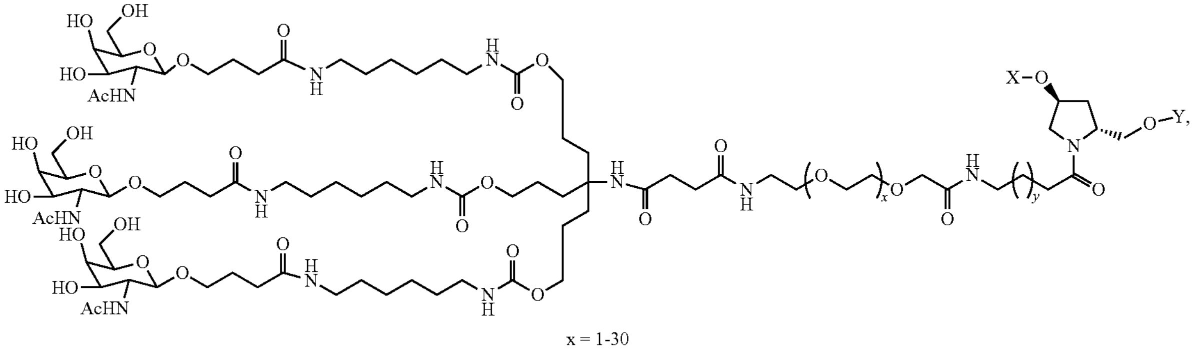
x = 1-30
y = 1-15

-continued
(Formula XXVII)
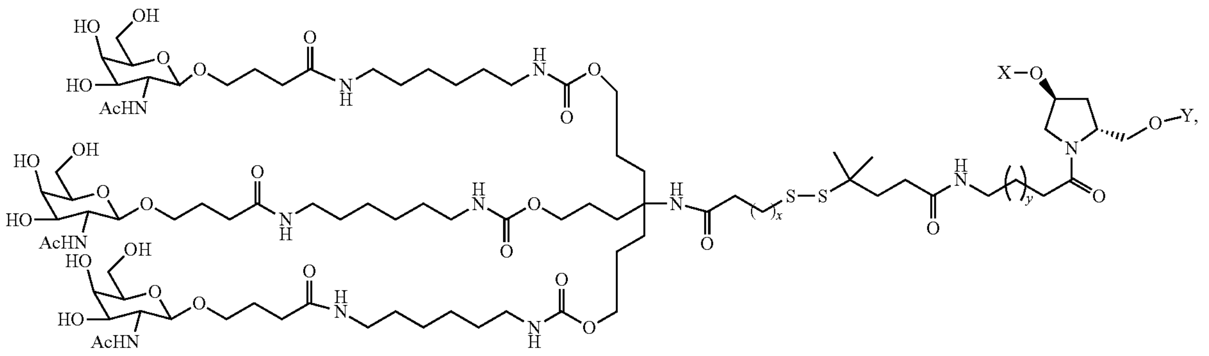
x = 0-30
y = 1-15
(Formula XXVIII)
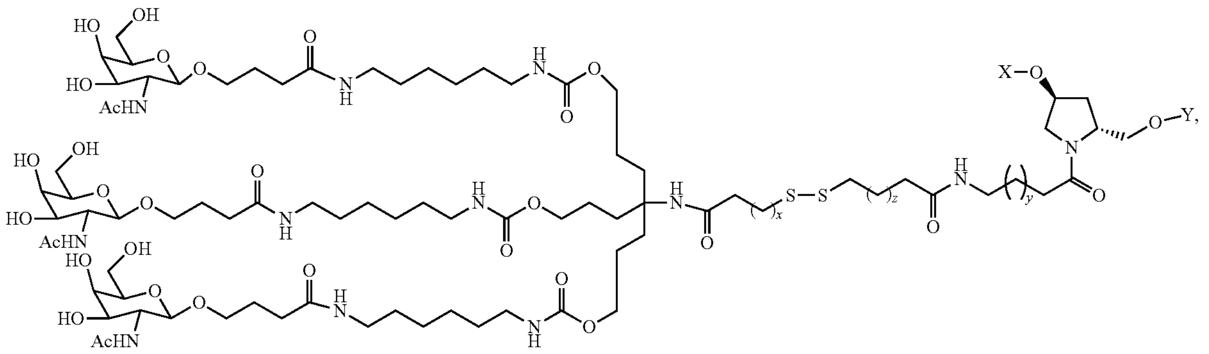
x = 0-30
y = 1-15
z = 1-20
(Formula XXIX)
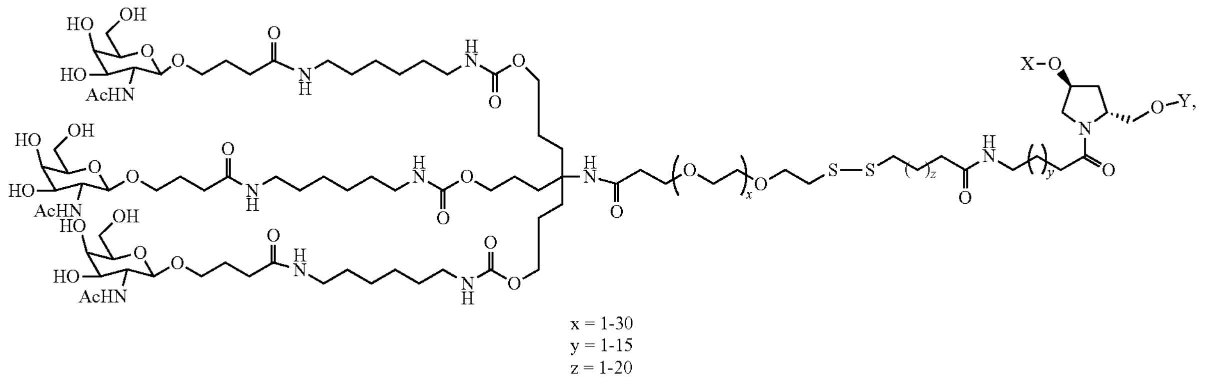
x = 1-30
y = 1-15
z = 1-20

-continued (Formula XXX)

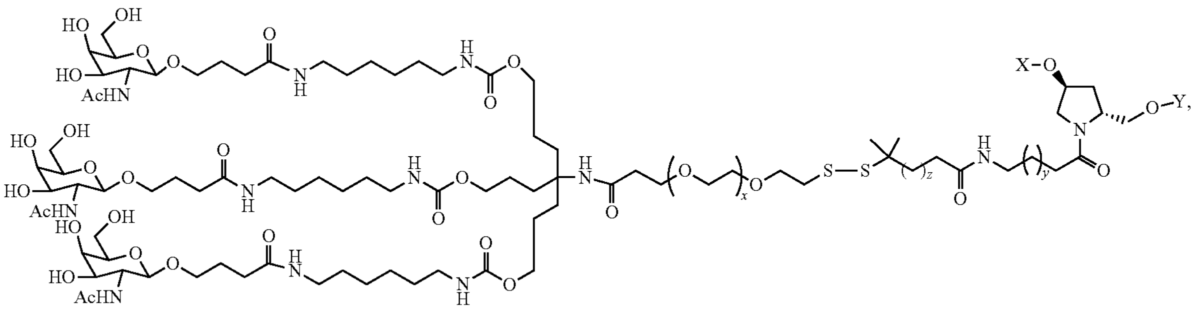

x = 1-30
y = 1-15
z = 1-20 when one of X or Y is an oligonucleotide, the other is a hydrogen.

E. Thermally Destabilizing Modifications

In certain embodiments, a dsRNA molecule can be optimized for RNA interference by incorporating thermally destabilizing modifications in the seed region of the antisense strand (i.e., at positions 2-9 of the 5'-end of the antisense strand) to reduce or inhibit off-target gene silencing. It has been discovered that dsRNAs with an antisense strand comprising at least one thermally destabilizing modification of the duplex within the first 9 nucleotide positions, counting from the 5' end, of the antisense strand have reduced off-target gene silencing activity. Accordingly, in some embodiments, the antisense strand comprises at least one (e.g., one, two, three, four, five, or more) thermally destabilizing modification of the duplex within the first 9 nucleotide positions of the 5' region of the antisense strand. In some embodiments, one or more thermally destabilizing modification(s) of the duplex is/are located in positions 2-9, or positions 4-8, from the 5'-end of the antisense strand. In some further embodiments, the thermally destabilizing modification(s) of the duplex is/are located at position 6, 7, or 8 from the 5'-end of the antisense strand. In still some further embodiments, the thermally destabilizing modification of the duplex is located at position 7 from the 5'-end of the antisense strand. The term "thermally destabilizing modification(s)" includes modification(s) that would result with a dsRNA with a lower overall melting temperature (Tm) (e.g., a Tm with one, two, three, or four degrees lower than the Tm of the dsRNA without having such modification(s). In some embodiments, the thermally destabilizing modification of the duplex is located at position 2, 3, 4, 5, or 9 from the 5'-end of the antisense strand.

The thermally destabilizing modifications can include, but are not limited to, abasic modification; mismatch with the opposing nucleotide in the opposing strand; and sugar modification such as 2'-deoxy modification or acyclic nucleotide, e.g., unlocked nucleic acids (UNA) or glycol nucleic acid (GNA).

Exemplified abasic modifications include, but are not limited to, the following:

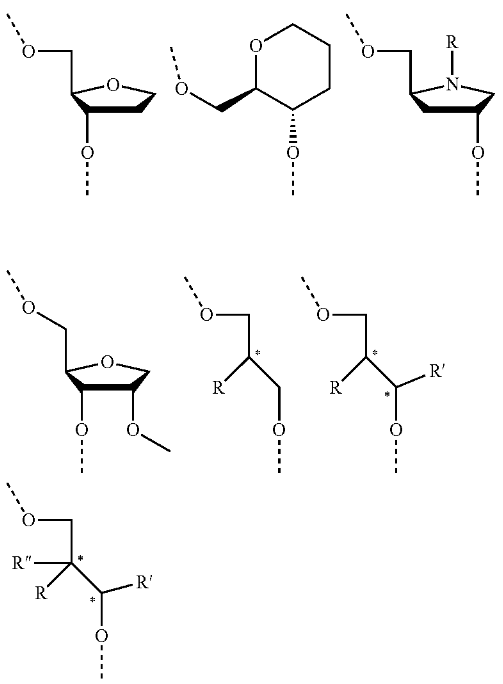

Wherein R=H, Me, Et or OMe; R'=H, Me, Et or OMe; R"=H, Me, Et or OMe

Mod2

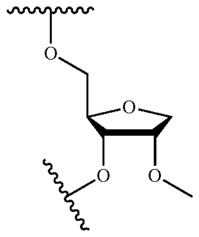

(2'-OMe Abasic Space)

-continued

Mod3

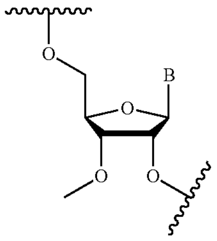

(3'-OMe)

Mod4

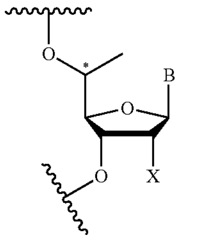

(5'-Me)

X = OMe, F

Mod5

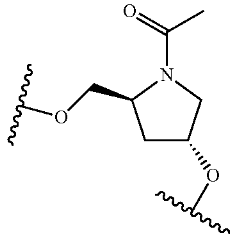

(Hyp-spacer)

wherein B is a modified or unmodified nucleobase.

Exemplified sugar modifications include, but are not limited to the following:

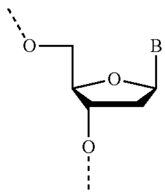

2'-deoxy

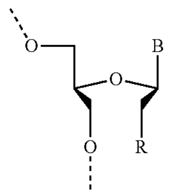

unlocked nucleic acid
R= H, OH, O-alkyl

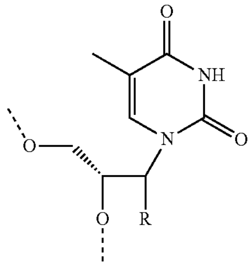

glycol nucleic acid
R= H, OH, O-alkyl

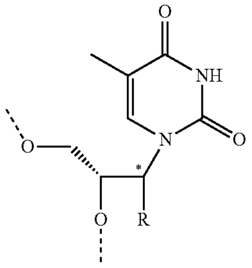

glycol nucleic acid
R= H, OH, O-alkyl

-continued

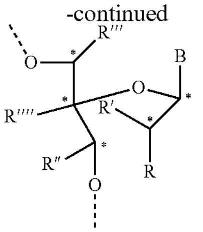

unlocked nucleic acid
R= H, OH, $CH_3$, $CH_2CH_3$, O-alkyl, $NH_2$, NHMe, $NMe_2$
R' = H, OH, $CH_3$, $CH_2CH_3$, O-alkyl, $NH_2$, NHMe, $NMe_2$
R'' = H, OH, $CH_3$, $CH_2CH_3$, O-alkyl, $NH_2$, NHMe, $NMe_2$
R''' = H, OH, $CH_3$, $CH_2CH_3$, O-alkyl, $NH_2$, NHMe, $NMe_2$
R'''' = H, OH, $CH_3$, $CH_2CH_3$, O-alkyl, $NH_2$, NHMe, $NMe_2$

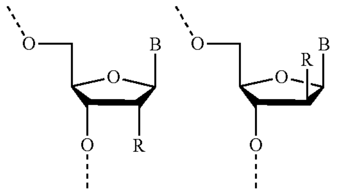

R = H, methyl, ethyl wherein B is a modified or unmodified nucleobase.

In some embodiments the thermally destabilizing modification of the duplex is selected from the group consisting of:

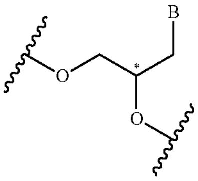
,
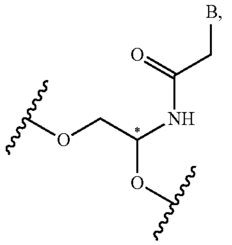

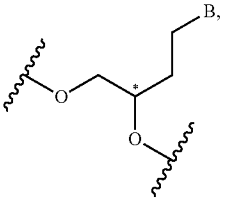

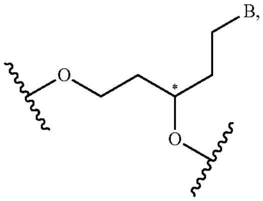

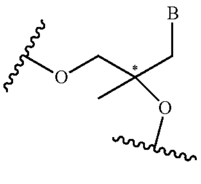
, and
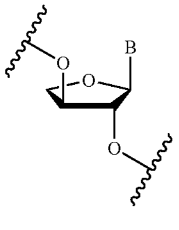

wherein B is a modified or unmodified nucleobase and the asterisk on each structure represents either R, S or racemic.

The term "acyclic nucleotide" refers to any nucleotide having an acyclic ribose sugar, for example, where any of bonds between the ribose carbons (e.g., C1'-C2', C2'-C3', C3'-C4', C4'-C4', or C1'-C4') is absent or at least one of ribose carbons or oxygen (e.g., C1', C2', C3', C4', or C4') are independently or in combination absent from the nucleotide. In some embodiments, acyclic nucleotide is

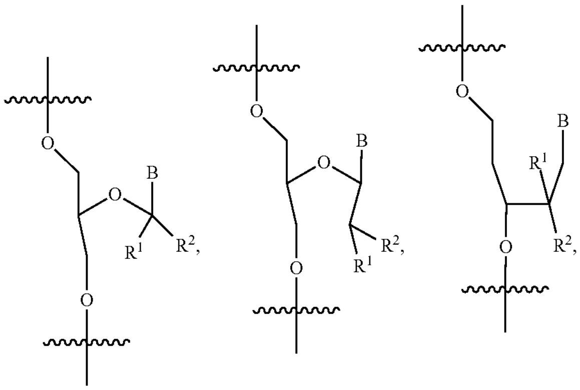

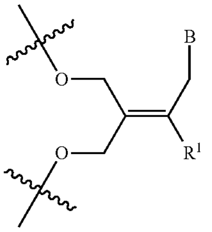

or

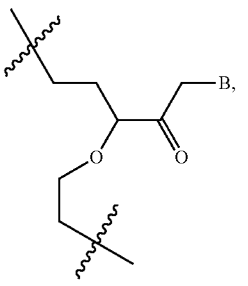

wherein B is a modified or unmodified nucleobase, $R^1$ and $R^2$ independently are H, halogen, $OR_3$, or alkyl; and $R_3$ is H, alkyl, cycloalkyl, aryl, aralkyl, heteroaryl or sugar). The term “UNA” refers to unlocked acyclic nucleic acid, wherein any of the bonds of the sugar has been removed, forming an unlocked “sugar” residue. In one example, UNA also encompasses monomers with bonds between C1'-C4' being removed (i.e. the covalent carbon-oxygen-carbon bond between the C1' and C4' carbons). In another example, the C2'-C3' bond (i.e. the covalent carbon-carbon bond between the C2' and C3' carbons) of the sugar is removed (see Mikhailov et. al., Tetrahedron Letters, 26 (17): 2059 (1985); and Fluiter et al., Mol. Biosyst., 10: 1039 (2009), which are hereby incorporated by reference in their entirety). The acyclic derivative provides greater backbone flexibility without affecting the Watson-Crick pairings. The acyclic nucleotide can be linked via 2'-5' or 3'-5' linkage.

The term ‘GNA’ refers to glycol nucleic acid which is a polymer similar to DNA or RNA but differing in the composition of its “backbone” in that is composed of repeating glycerol units linked by phosphodiester bonds:

(R)-GNA

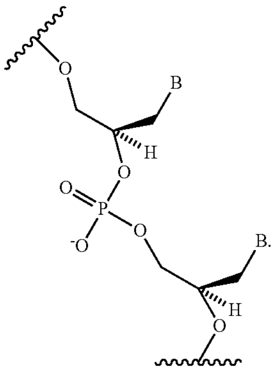

The thermally destabilizing modification of the duplex can be mismatches (i.e., noncomplementary base pairs) between the thermally destabilizing nucleotide and the opposing nucleotide in the opposite strand within the dsRNA duplex. Exemplary mismatch base pairs include G:G, G:A, G:U, G:T, A:A, A:C, C:C, C:U, C:T, U:U, T:T, U:T, or a combination thereof. Other mismatch base pairings known in the art are also amenable to the present invention. A mismatch can occur between nucleotides that are either naturally occurring nucleotides or modified nucleotides, i.e., the mismatch base pairing can occur between the nucleobases from respective nucleotides independent of the modifications on the ribose sugars of the nucleotides. In certain embodiments, the dsRNA molecule contains at least one nucleobase in the mismatch pairing that is a 2'-deoxy nucleobase; e.g., the 2'-deoxy nucleobase is in the sense strand.

In some embodiments, the thermally destabilizing modification of the duplex in the seed region of the antisense strand includes nucleotides with impaired W-C H-bonding to complementary base on the target mRNA, such as:

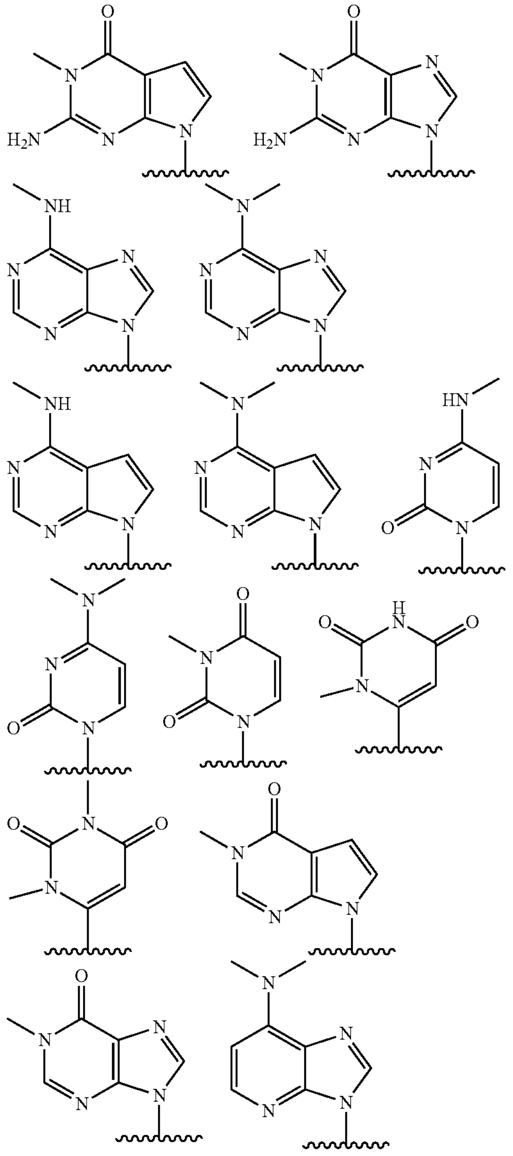

-continued

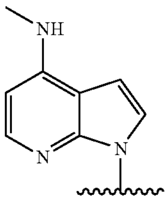

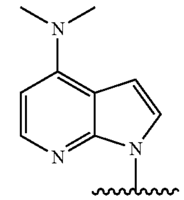

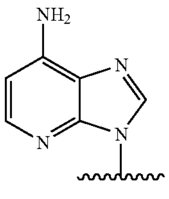

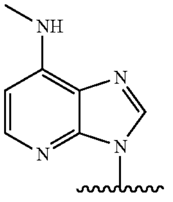

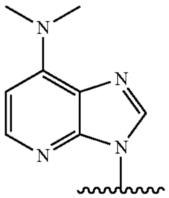

More examples of abasic nucleotide, acyclic nucleotide modifications (including UNA and GNA), and mismatch modifications have been described in detail in WO 2011/133876, which is herein incorporated by reference in its entirety.

The thermally destabilizing modifications may also include universal base with reduced or abolished capability to form hydrogen bonds with the opposing bases, and phosphate modifications.

In some embodiments, the thermally destabilizing modification of the duplex includes nucleotides with non-canonical bases such as, but not limited to, nucleobase modifications with impaired or completely abolished capability to form hydrogen bonds with bases in the opposite strand. These nucleobase modifications have been evaluated for destabilization of the central region of the dsRNA duplex as described in WO 2010/0011895, which is herein incorporated by reference in its entirety. Exemplary nucleobase modifications are:

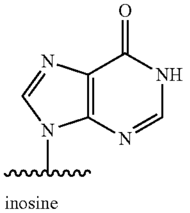

inosine

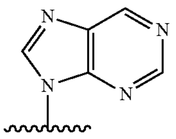

nebularine

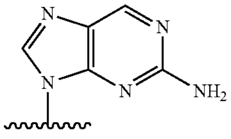

2-aminopurine

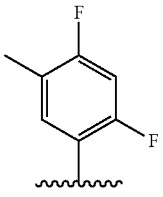

2,4-difluorotoluene

-continued

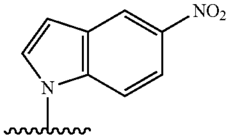

5-nitroindole

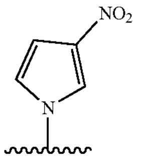

3-nitropyrrole

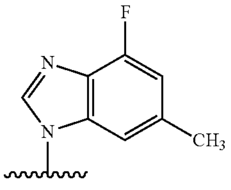

4-Fluoro-6-methylbenzimidazole

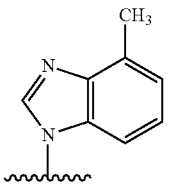

4-Methylbenzimidazole

In some embodiments, the thermally destabilizing modification of the duplex in the seed region of the antisense strand includes one or more α-nucleotide complementary to the base on the target mRNA, such as:

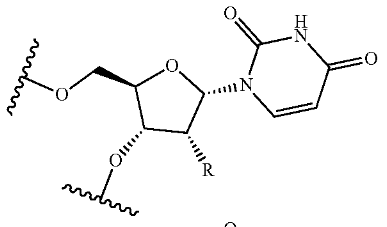

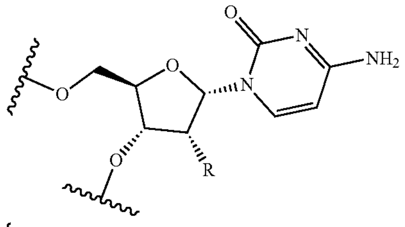

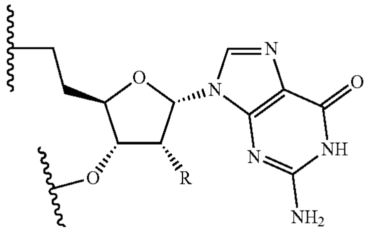

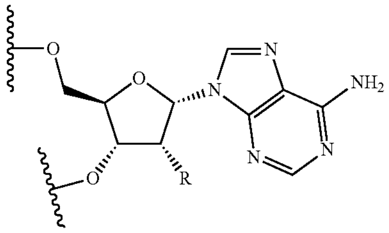

wherein R is H, OH, $OCH_3$, F, $NH_2$, NHMe, $NMe_2$ or O-alkyl.

Exemplary phosphate modifications known to decrease the thermal stability of dsRNA duplexes compared to natural phosphodiester linkages are:

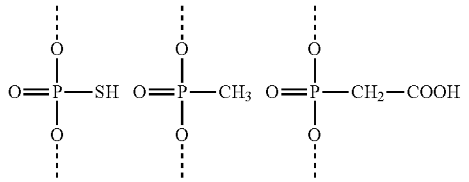

R = alkyl

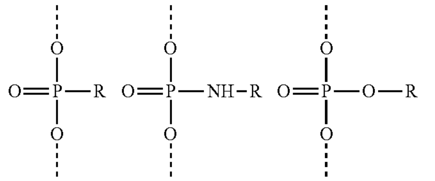

The alkyl for the R group can be a $C_1$-$C_6$alkyl. Specific alkyls for the R group include, but are not limited to methyl, ethyl, propyl, isopropyl, butyl, pentyl and hexyl.

As the skilled artisan will recognize, in view of the functional role of nucleobases is defining specificity of a RNAi agent of the disclosure, while nucleobase modifications can be performed in the various manners as described herein, e.g., to introduce destabilizing modifications into a RNAi agent of the disclosure, e.g., for purpose of enhancing on-target effect relative to off-target effect, the range of modifications available and, in general, present upon RNAi agents of the disclosure tends to be much greater for non-nucleobase modifications, e.g., modifications to sugar groups or phosphate backbones of polyribonucleotides. Such modifications are described in greater detail in other sections of the instant disclosure and are expressly contemplated for RNAi agents of the disclosure, either possessing native nucleobases or modified nucleobases as described above or elsewhere herein.

In addition to the antisense strand comprising a thermally destabilizing modification, the dsRNA can also comprise one or more stabilizing modifications. For example, the dsRNA can comprise at least two (e.g., two, three, four, five, six, seven, eight, nine, ten, or more) stabilizing modifications. Without limitations, the stabilizing modifications all can be present in one strand. In some embodiments, both the sense and the antisense strands comprise at least two stabilizing modifications. The stabilizing modification can occur on any nucleotide of the sense strand or antisense strand. For instance, the stabilizing modification can occur on every nucleotide on the sense strand or antisense strand; each stabilizing modification can occur in an alternating pattern on the sense strand or antisense strand; or the sense strand or antisense strand comprises both stabilizing modification in an alternating pattern. The alternating pattern of the stabilizing modifications on the sense strand may be the same or different from the antisense strand, and the alternating pattern of the stabilizing modifications on the sense strand can have a shift relative to the alternating pattern of the stabilizing modifications on the antisense strand.

In some embodiments, the antisense strand comprises at least two (e.g., two, three, four, five, six, seven, eight, nine, ten, or more) stabilizing modifications. Without limitations, a stabilizing modification in the antisense strand can be present at any positions.

In some embodiments, the antisense strand comprises stabilizing modifications at positions 2, 6, 8, 9, 14, and 16 from the 5'-end. In some other embodiments, the antisense strand comprises stabilizing modifications at positions 2, 6, 14, and 16 from the 5'-end. In still some other embodiments, the antisense strand comprises stabilizing modifications at positions 2, 14, and 16 from the 5'-end.

In some embodiments, the antisense strand comprises at least one stabilizing modification adjacent to the destabilizing modification. For example, the stabilizing modification can be the nucleotide at the 5'-end or the 3'-end of the destabilizing modification, i.e., at position −1 or +1 from the position of the destabilizing modification. In some embodiments, the antisense strand comprises a stabilizing modification at each of the 5'-end and the 3'-end of the destabilizing modification, i.e., positions −1 and +1 from the position of the destabilizing modification.

In some embodiments, the antisense strand comprises at least two stabilizing modifications at the 3'-end of the destabilizing modification, i.e., at positions +1 and +2 from the position of the destabilizing modification.

In some embodiments, the sense strand comprises at least two (e.g., two, three, four, five, six, seven, eight, nine, ten or more) stabilizing modifications. Without limitations, a stabilizing modification in the sense strand can be present at any positions. In some embodiments, the sense strand comprises stabilizing modifications at positions 7, 10, and 11 from the 5'-end. In some other embodiments, the sense strand comprises stabilizing modifications at positions 7, 9, 10, and 11 from the 5'-end. In some embodiments, the sense strand comprises stabilizing modifications at positions opposite or complimentary to positions 11, 12, and 15 of the antisense strand, counting from the 5'-end of the antisense strand. In some other embodiments, the sense strand comprises stabilizing modifications at positions opposite or complimentary to positions 11, 12, 13, and 15 of the antisense strand, counting from the 5'-end of the antisense strand. In some embodiments, the sense strand comprises a block of two, three, or four stabilizing modifications.

In some embodiments, the sense strand does not comprise a stabilizing modification in position opposite or complimentary to the thermally destabilizing modification of the duplex in the antisense strand.

Exemplary thermally stabilizing modifications include, but are not limited to, 2'-fluoro modifications. Other thermally stabilizing modifications include, but are not limited to, LNA.

In some embodiments, the dsRNA of the disclosure comprises at least four (e.g., four, five, six, seven, eight, nine, ten, or more) 2'-fluoro nucleotides. Without limitations, the 2'-fluoro nucleotides all can be present in one strand. In some embodiments, both the sense and the antisense strands comprise at least two 2'-fluoro nucleotides. The 2'-fluoro modification can occur on any nucleotide of the sense strand or antisense strand. For instance, the 2'-fluoro modification can occur on every nucleotide on the sense strand or antisense strand; each 2'-fluoro modification can occur in an alternating pattern on the sense strand or antisense strand; or the sense strand or antisense strand comprises both 2'-fluoro modifications in an alternating pattern. The alternating pattern of the 2'-fluoro modifications on the sense strand may be the same or different from the antisense strand, and the alternating pattern of the 2'-fluoro modifications on the sense strand can have a shift relative to the alternating pattern of the 2'-fluoro modifications on the antisense strand.

In some embodiments, the antisense strand comprises at least two (e.g., two, three, four, five, six, seven, eight, nine, ten, or more) 2'-fluoro nucleotides. Without limitations, a 2'-fluoro modification in the antisense strand can be present at any positions. In some embodiments, the antisense comprises 2'-fluoro nucleotides at positions 2, 6, 8, 9, 14, and 16 from the 5'-end. In some other embodiments, the antisense comprises 2'-fluoro nucleotides at positions 2, 6, 14, and 16 from the 5'-end. In still some other embodiments, the antisense comprises 2'-fluoro nucleotides at positions 2, 14, and 16 from the 5'-end.

In some embodiments, the antisense strand comprises at least one 2'-fluoro nucleotide adjacent to the destabilizing modification. For example, the 2'-fluoro nucleotide can be the nucleotide at the 5'-end or the 3'-end of the destabilizing modification, i.e., at position −1 or +1 from the position of the destabilizing modification. In some embodiments, the antisense strand comprises a 2'-fluoro nucleotide at each of the 5'-end and the 3'-end of the destabilizing modification, i.e., positions −1 and +1 from the position of the destabilizing modification.

In some embodiments, the antisense strand comprises at least two 2'-fluoro nucleotides at the 3'-end of the destabilizing modification, i.e., at positions +1 and +2 from the position of the destabilizing modification.

In some embodiments, the sense strand comprises at least two (e.g., two, three, four, five, six, seven, eight, nine, ten, or more) 2'-fluoro nucleotides. Without limitations, a 2'-fluoro modification in the sense strand can be present at any positions. In some embodiments, the antisense comprises 2'-fluoro nucleotides at positions 7, 10, and 11 from the 5'-end. In some other embodiments, the sense strand comprises 2'-fluoro nucleotides at positions 7, 9, 10, and 11 from the 5'-end. In some embodiments, the sense strand comprises 2'-fluoro nucleotides at positions opposite or complimentary to positions 11, 12, and 15 of the antisense strand, counting from the 5'-end of the antisense strand. In some other embodiments, the sense strand comprises 2'-fluoro nucleotides at positions opposite or complimentary to positions 11, 12, 13, and 15 of the antisense strand, counting from the 5'-end of the antisense strand. In some embodiments, the sense strand comprises a block of two, three, or four 2'-fluoro nucleotides.

In some embodiments, the sense strand does not comprise a 2'-fluoro nucleotide in position opposite or complimentary to the thermally destabilizing modification of the duplex in the antisense strand.

In some embodiments, the dsRNA molecule of the disclosure comprises a 21 nucleotides (nt) sense strand and a 23 nucleotides (nt) antisense, wherein the antisense strand contains at least one thermally destabilizing nucleotide, where the at least one thermally destabilizing nucleotide occurs in the seed region of the antisense strand (i.e., at position 2-9 of the 5'-end of the antisense strand), wherein one end of the dsRNA is blunt, while the other end is comprises a 2 nt overhang, and wherein the dsRNA optionally further has at least one (e.g., one, two, three, four, five, six, or all seven) of the following characteristics: (i) the antisense comprises 2, 3, 4, 5, or 6 2'-fluoro modifications; (ii) the antisense comprises 1, 2, 3, 4, or 5 phosphorothioate internucleotide linkages; (iii) the sense strand is conjugated with a ligand; (iv) the sense strand comprises 2, 3, 4, or 5 2'-fluoro modifications; (v) the sense strand comprises 1, 2, 3, 4, or 5 phosphorothioate internucleotide linkages; (vi) the dsRNA comprises at least four 2'-fluoro modifications; and (vii) the dsRNA comprises a blunt end at 5'-end of the antisense strand. In some embodiments, the 2 nt overhang is at the 3'-end of the antisense.

In some embodiments, every nucleotide in the sense strand and antisense strand of the dsRNA molecule may be modified. Each nucleotide may be modified with the same or different modification which can include one or more alteration of one or both of the non-linking phosphate oxygens or of one or more of the linking phosphate oxygens; alteration of a constituent of the ribose sugar, e.g., of the 2' hydroxyl on the ribose sugar; wholesale replacement of the phosphate moiety with "dephospho" linkers; modification or replacement of a naturally occurring base; and replacement or modification of the ribose-phosphate backbone.

As nucleic acids are polymers of subunits, many of the modifications occur at a position which is repeated within a nucleic acid, e.g., a modification of a base, or a phosphate moiety, or a non-linking O of a phosphate moiety. In some cases, the modification will occur at all of the subject positions in the nucleic acid but in many cases it will not. By way of example, a modification may only occur at a 3' or 5' terminal position, may only occur in a terminal region, e.g., at a position on a terminal nucleotide or in the last 2, 3, 4, 5, or 10 nucleotides of a strand. A modification may occur in a double strand region, a single strand region, or in both. A modification may occur only in the double strand region of an RNA or may only occur in a single strand region of an RNA. E.g., a phosphorothioate modification at a non-linking O position may only occur at one or both termini, may only occur in a terminal region, e.g., at a position on a terminal nucleotide or in the last 2, 3, 4, 5, or 10 nucleotides of a strand, or may occur in double strand and single strand regions, particularly at termini. The 5' end or ends can be phosphorylated.

It may be possible, e.g., to enhance stability, to include particular bases in overhangs, or to include modified nucleotides or nucleotide surrogates, in single strand overhangs, e.g., in a 5' or 3' overhang, or in both. E.g., it can be desirable to include purine nucleotides in overhangs. In some embodiments all or some of the bases in a 3' or 5' overhang may be modified, e.g., with a modification described herein. Modifications can include, e.g., the use of modifications at the 2' position of the ribose sugar with modifications that are known in the art, e.g., the use of deoxyribonucleotides, 2'-deoxy-2'-fluoro (2'-F) or 2'-O-methyl modified instead of the ribosugar of the nucleobase, and modifications in the phosphate group, e.g., phosphorothioate modifications. Overhangs need not be homologous with the target sequence.

In some embodiments, each residue of the sense strand and antisense strand is independently modified with LNA, HNA, CeNA, 2'-methoxyethyl, 2'-O-methyl, 2'-O-allyl, 2'-C-allyl, 2'-deoxy, or 2'-fluoro. The strands can contain more than one modification. In some embodiments, each residue of the sense strand and antisense strand is independently modified with 2'-O-methyl or 2'-fluoro. It is to be understood that these modifications are in addition to the at least one thermally destabilizing modification of the duplex present in the antisense strand.

At least two different modifications are typically present on the sense strand and antisense strand. Those two modifications may be the 2'-deoxy, 2'-O-methyl, or 2'-fluoro modifications, acyclic nucleotides or others. In some embodiments, the sense strand and antisense strand each comprises two differently modified nucleotides selected from 2'-O-methyl or 2'-deoxy. In some embodiments, each residue of the sense strand and antisense strand is independently modified with 2'-O-methyl nucleotide, 2'-deoxy nucleotide, 2'-deoxy-2'-fluoro nucleotide, 2'-O-N-methylacetamido (2'-O-NMA) nucleotide, a 2'-O-dimethylaminoethoxyethyl (2'-O-DMAEOE) nucleotide, 2'-O-aminopropyl (2'-O-AP) nucleotide, or 2'-ara-F nucleotide. Again, it is to be understood that these modifications are in addition to the at least one thermally destabilizing modification of the duplex present in the antisense strand.

In some embodiments, the dsRNA molecule of the disclosure comprises modifications of an alternating pattern, particular in the B1, B2, B3, B1', B2', B3', B4' regions. The term "alternating motif" or "alternative pattern" as used herein refers to a motif having one or more modifications, each modification occurring on alternating nucleotides of one strand. The alternating nucleotide may refer to one per every other nucleotide or one per every three nucleotides, or a similar pattern. For example, if A, B and C each represent one type of modification to the nucleotide, the alternating motif can be "ABABABABABAB . . . ," "AABBAABBAABB . . . ," "AABAABAABAAB . . . ," "AAABAAABAAAB . . . ," "AAABBBAAABBB . . . ," or "ABCABCABCABC . . . ," etc.

The type of modifications contained in the alternating motif may be the same or different. For example, if A, B, C, D each represent one type of modification on the nucleotide, the alternating pattern, i.e., modifications on every other nucleotide, may be the same, but each of the sense strand or antisense strand can be selected from several possibilities of modifications within the alternating motif such as "ABABAB . . . ", "ACACAC . . . " "BDBDBD . . . " or "CDCDCD . . . ," etc.

In some embodiments, the dsRNA molecule of the disclosure comprises the modification pattern for the alternating motif on the sense strand relative to the modification pattern for the alternating motif on the antisense strand is shifted. The shift may be such that the modified group of nucleotides of the sense strand corresponds to a differently modified group of nucleotides of the antisense strand and vice versa. For example, the sense strand when paired with the antisense strand in the dsRNA duplex, the alternating motif in the sense strand may start with "ABABAB" from 5'-3' of the strand and the alternating motif in the antisense strand may start with "BABABA" from 3'-5' of the strand within the duplex region. As another example, the alternating motif in the sense strand may start with "AABBAABB" from 5'-3' of the strand and the alternating motif in the antisense strand may start with "BBAABBAA" from 3'-5' of the strand within the duplex region, so that there is a complete or partial shift of the modification patterns between the sense strand and the antisense strand.

The dsRNA molecule of the disclosure may further comprise at least one phosphorothioate or methylphosphonate internucleotide linkage. The phosphorothioate or methylphosphonate internucleotide linkage modification may occur on any nucleotide of the sense strand or antisense strand or both in any position of the strand. For instance, the internucleotide linkage modification may occur on every nucleotide on the sense strand or antisense strand; each internucleotide linkage modification may occur in an alternating pattern on the sense strand or antisense strand; or the sense strand or antisense strand comprises both internucleotide linkage modifications in an alternating pattern. The alternating pattern of the internucleotide linkage modification on the sense strand may be the same or different from the antisense strand, and the alternating pattern of the internucleotide linkage modification on the sense strand may have a shift relative to the alternating pattern of the internucleotide linkage modification on the antisense strand.

In some embodiments, the dsRNA molecule comprises the phosphorothioate or methylphosphonate internucleotide linkage modification in the overhang region. For example, the overhang region comprises two nucleotides having a phosphorothioate or methylphosphonate internucleotide linkage between the two nucleotides. Internucleotide linkage modifications also may be made to link the overhang nucleotides with the terminal paired nucleotides within duplex region. For example, at least 2, 3, 4, or all the overhang nucleotides may be linked through phosphorothioate or methylphosphonate internucleotide linkage, and optionally, there may be additional phosphorothioate or methylphosphonate internucleotide linkages linking the overhang nucleotide with a paired nucleotide that is next to the overhang nucleotide. For instance, there may be at least two phosphorothioate internucleotide linkages between the terminal three nucleotides, in which two of the three nucleotides are overhang nucleotides, and the third is a paired nucleotide next to the overhang nucleotide. In some embodiments, these terminal three nucleotides may be at the 3'-end of the antisense strand.

In some embodiments, the sense strand of the dsRNA molecule comprises 1-10 blocks of two to ten phosphorothioate or methylphosphonate internucleotide linkages separated by 1, 2, 3, 4, 5, 6, 7, 8, 9, 10, 11, 12, 13, 14, 15, or 16 phosphate internucleotide linkages, wherein one of the phosphorothioate or methylphosphonate internucleotide linkages is placed at any position in the oligonucleotide sequence and the said sense strand is paired with an antisense strand comprising any combination of phosphorothioate, methylphosphonate, and phosphate internucleotide linkages or an antisense strand comprising either phosphorothioate or methylphosphonate or phosphate linkage.

In some embodiments, the antisense strand of the dsRNA molecule comprises two blocks of two phosphorothioate or methylphosphonate internucleotide linkages separated by 1, 2, 3, 4, 5, 6, 7, 8, 9, 10, 11, 12, 13, 14, 15, 16, 17, or 18 phosphate internucleotide linkages, wherein one of the phosphorothioate or methylphosphonate internucleotide linkages is placed at any position in the oligonucleotide sequence and the said antisense strand is paired with a sense strand comprising any combination of phosphorothioate, methylphosphonate, and phosphate internucleotide linkages or an antisense strand comprising either phosphorothioate or methylphosphonate or phosphate linkage.

In some embodiments, the antisense strand of the dsRNA molecule comprises two blocks of three phosphorothioate or methylphosphonate internucleotide linkages separated by 1, 2, 3, 4, 5, 6, 7, 8, 9, 10, 11, 12, 13, 14, 15, or 16 phosphate internucleotide linkages, wherein one of the phosphorothioate or methylphosphonate internucleotide linkages is placed at any position in the oligonucleotide sequence and the said antisense strand is paired with a sense strand comprising any combination of phosphorothioate, methylphosphonate, and phosphate internucleotide linkages or an antisense strand comprising either phosphorothioate or methylphosphonate or phosphate linkage.

In some embodiments, the antisense strand of the dsRNA molecule comprises two blocks of four phosphorothioate or methylphosphonate internucleotide linkages separated by 1, 2, 3, 4, 5, 6, 7, 8, 9, 10, 11, 12, 13, or 14 phosphate internucleotide linkages, wherein one of the phosphorothioate or methylphosphonate internucleotide linkages is placed at any position in the oligonucleotide sequence and the said antisense strand is paired with a sense strand comprising any combination of phosphorothioate, methylphosphonate, and phosphate internucleotide linkages or an antisense strand comprising either phosphorothioate or methylphosphonate or phosphate linkage.

In some embodiments, the antisense strand of the dsRNA molecule comprises two blocks of five phosphorothioate or methylphosphonate internucleotide linkages separated by 1, 2, 3, 4, 5, 6, 7, 8, 9, 10, 11, or 12 phosphate internucleotide linkages, wherein one of the phosphorothioate or methylphosphonate internucleotide linkages is placed at any position in the oligonucleotide sequence and the said antisense strand is paired with a sense strand comprising any combination of phosphorothioate, methylphosphonate, and phosphate internucleotide linkages or an antisense strand comprising either phosphorothioate or methylphosphonate or phosphate linkage.

In some embodiments, the antisense strand of the dsRNA molecule comprises two blocks of six phosphorothioate or methylphosphonate internucleotide linkages separated by 1, 2, 3, 4, 5, 6, 7, 8, 9, or 10 phosphate internucleotide linkages, wherein one of the phosphorothioate or methylphosphonate internucleotide linkages is placed at any position in the oligonucleotide sequence and the said antisense strand is paired with a sense strand comprising any combination of phosphorothioate, methylphosphonate, and phosphate internucleotide linkages or an antisense strand comprising either phosphorothioate or methylphosphonate or phosphate linkage.

In some embodiments, the antisense strand of the dsRNA molecule comprises two blocks of seven phosphorothioate or methylphosphonate internucleotide linkages separated by 1, 2, 3, 4, 5, 6, 7, or 8 phosphate internucleotide linkages, wherein one of the phosphorothioate or methylphosphonate internucleotide linkages is placed at any position in the oligonucleotide sequence and the said antisense strand is paired with a sense strand comprising any combination of phosphorothioate, methylphosphonate, and phosphate internucleotide linkages or an antisense strand comprising either phosphorothioate or methylphosphonate or phosphate linkage.

In some embodiments, the antisense strand of the dsRNA molecule comprises two blocks of eight phosphorothioate or methylphosphonate internucleotide linkages separated by 1, 2, 3, 4, 5, or 6 phosphate internucleotide linkages, wherein one of the phosphorothioate or methylphosphonate internucleotide linkages is placed at any position in the oligonucleotide sequence and the said antisense strand is paired with a sense strand comprising any combination of phosphorothioate, methylphosphonate, and phosphate internucleotide linkages or an antisense strand comprising either phosphorothioate or methylphosphonate or phosphate linkage.

In some embodiments, the antisense strand of the dsRNA molecule comprises two blocks of nine phosphorothioate or methylphosphonate internucleotide linkages separated by 1, 2, 3, or 4 phosphate internucleotide linkages, wherein one of the phosphorothioate or methylphosphonate internucleotide linkages is placed at any position in the oligonucleotide sequence and the said antisense strand is paired with a sense strand comprising any combination of phosphorothioate, methylphosphonate, and phosphate internucleotide linkages or an antisense strand comprising either phosphorothioate or methylphosphonate or phosphate linkage.

In some embodiments, the dsRNA molecule of the disclosure further comprises one or more phosphorothioate or methylphosphonate internucleotide linkage modification within positions 1-10 of the termini position(s) of the sense or antisense strand. For example, at least 2, 3, 4, 5, 6, 7, 8, 9, or 10 nucleotides may be linked through phosphorothioate or methylphosphonate internucleotide linkage at one end or both ends of the sense or antisense strand.

In some embodiments, the dsRNA molecule of the disclosure further comprises one or more phosphorothioate or methylphosphonate internucleotide linkage modification within positions 1-10 of the internal region of the duplex of each of the sense or antisense strand. For example, at least 2, 3, 4, 5, 6, 7, 8, 9, or 10 nucleotides may be linked through phosphorothioate methylphosphonate internucleotide linkage at position 8-16 of the duplex region counting from the 5'-end of the sense strand; the dsRNA molecule can optionally further comprise one or more phosphorothioate or methylphosphonate internucleotide linkage modification within positions 1-10 of the termini position(s).

In some embodiments, the dsRNA molecule of the disclosure further comprises one to five phosphorothioate or methylphosphonate internucleotide linkage modification(s) within position 1-5 and one to five phosphorothioate or methylphosphonate internucleotide linkage modification(s) within position 18-23 of the sense strand (counting from the 5'-end), and one to five phosphorothioate or methylphosphonate internucleotide linkage modification at positions 1 and 2 and one to five within positions 18-23 of the antisense strand (counting from the 5'-end).

In some embodiments, the dsRNA molecule of the disclosure further comprises one phosphorothioate internucleotide linkage modification within position 1-5 and one phosphorothioate or methylphosphonate internucleotide linkage modification within position 18-23 of the sense strand (counting from the 5'-end), and one phosphorothioate internucleotide linkage modification at positions 1 and 2 and two phosphorothioate or methylphosphonate internucleotide linkage modifications within positions 18-23 of the antisense strand (counting from the 5'-end).

In some embodiments, the dsRNA molecule of the disclosure further comprises two phosphorothioate internucleotide linkage modifications within position 1-5 and one phosphorothioate internucleotide linkage modification within position 18-23 of the sense strand (counting from the 5'-end), and one phosphorothioate internucleotide linkage modification at positions 1 and 2 and two phosphorothioate internucleotide linkage modifications within positions 18-23 of the antisense strand (counting from the 5'-end).

In some embodiments, the dsRNA molecule of the disclosure further comprises two phosphorothioate internucleotide linkage modifications within position 1-5 and two phosphorothioate internucleotide linkage modifications within position 18-23 of the sense strand (counting from the 5'-end), and one phosphorothioate internucleotide linkage modification at positions 1 and 2 and two phosphorothioate internucleotide linkage modifications within positions 18-23 of the antisense strand (counting from the 5'-end).

In some embodiments, the dsRNA molecule of the disclosure further comprises two phosphorothioate internucleotide linkage modifications within position 1-5 and two phosphorothioate internucleotide linkage modifications within position 18-23 of the sense strand (counting from the 5'-end), and one phosphorothioate internucleotide linkage modification at positions 1 and 2 and one phosphorothioate internucleotide linkage modification within positions 18-23 of the antisense strand (counting from the 5'-end).

In some embodiments, the dsRNA molecule of the disclosure further comprises one phosphorothioate internucleotide linkage modification within position 1-5 and one phosphorothioate internucleotide linkage modification within position 18-23 of the sense strand (counting from the 5'-end), and two phosphorothioate internucleotide linkage modifications at positions 1 and 2 and two phosphorothioate internucleotide linkage modifications within positions 18-23 of the antisense strand (counting from the 5'-end).

In some embodiments, the dsRNA molecule of the disclosure further comprises one phosphorothioate internucleotide linkage modification within position 1-5 and one within position 18-23 of the sense strand (counting from the 5'-end), and two phosphorothioate internucleotide linkage modification at positions 1 and 2 and one phosphorothioate internucleotide linkage modification within positions 18-23 of the antisense strand (counting from the 5'-end).

In some embodiments, the dsRNA molecule of the disclosure further comprises one phosphorothioate internucleotide linkage modification within position 1-5 (counting from the 5'-end) of the sense strand, and two phosphorothioate internucleotide linkage modifications at positions 1 and 2 and one phosphorothioate internucleotide linkage modification within positions 18-23 of the antisense strand (counting from the 5'-end).

In some embodiments, the dsRNA molecule of the disclosure further comprises two phosphorothioate internucleotide linkage modifications within position 1-5 (counting from the 5'-end) of the sense strand, and one phosphorothioate internucleotide linkage modification at positions 1 and 2 and two phosphorothioate internucleotide linkage modifications within positions 18-23 of the antisense strand (counting from the 5'-end).

In some embodiments, the dsRNA molecule of the disclosure further comprises two phosphorothioate internucleotide linkage modifications within position 1-5 and one within position 18-23 of the sense strand (counting from the 5'-end), and two phosphorothioate internucleotide linkage modifications at positions 1 and 2 and one phosphorothioate internucleotide linkage modification within positions 18-23 of the antisense strand (counting from the 5'-end).

In some embodiments, the dsRNA molecule of the disclosure further comprises two phosphorothioate internucleotide linkage modifications within position 1-5 and one phosphorothioate internucleotide linkage modification within position 18-23 of the sense strand (counting from the 5'-end), and two phosphorothioate internucleotide linkage modifications at positions 1 and 2 and two phosphorothioate internucleotide linkage modifications within positions 18-23 of the antisense strand (counting from the 5'-end).

In some embodiments, the dsRNA molecule of the disclosure further comprises two phosphorothioate internucleotide linkage modifications within position 1-5 and one phosphorothioate internucleotide linkage modification within position 18-23 of the sense strand (counting from the 5'-end), and one phosphorothioate internucleotide linkage modification at positions 1 and 2 and two phosphorothioate internucleotide linkage modifications within positions 18-23 of the antisense strand (counting from the 5'-end).

In some embodiments, the dsRNA molecule of the disclosure further comprises two phosphorothioate internucleotide linkage modifications at position 1 and 2, and two phosphorothioate internucleotide linkage modifications at position 20 and 21 of the sense strand (counting from the 5'-end), and one phosphorothioate internucleotide linkage modification at positions 1 and one at position 21 of the antisense strand (counting from the 5'-end).

In some embodiments, the dsRNA molecule of the disclosure further comprises one phosphorothioate internucleotide linkage modification at position 1, and one phosphorothioate internucleotide linkage modification at position 21 of the sense strand (counting from the 5'-end), and two phosphorothioate internucleotide linkage modifications at positions 1 and 2 and two phosphorothioate internucleotide linkage modifications at positions 20 and 21 the antisense strand (counting from the 5'-end).

In some embodiments, the dsRNA molecule of the disclosure further comprises two phosphorothioate internucleotide linkage modifications at position 1 and 2, and two phosphorothioate internucleotide linkage modifications at position 21 and 22 of the sense strand (counting from the 5'-end), and one phosphorothioate internucleotide linkage modification at positions 1 and one phosphorothioate internucleotide linkage modification at position 21 of the antisense strand (counting from the 5'-end).

In some embodiments, the dsRNA molecule of the disclosure further comprises one phosphorothioate internucleotide linkage modification at position 1, and one phosphorothioate internucleotide linkage modification at position 21 of the sense strand (counting from the 5'-end), and two phosphorothioate internucleotide linkage modifications at positions 1 and 2 and two phosphorothioate internucleotide linkage modifications at positions 21 and 22 the antisense strand (counting from the 5'-end).

In some embodiments, the dsRNA molecule of the disclosure further comprises two phosphorothioate internucleotide linkage modifications at position 1 and 2, and two phosphorothioate internucleotide linkage modifications at position 22 and 23 of the sense strand (counting from the 5'-end), and one phosphorothioate internucleotide linkage modification at positions 1 and one phosphorothioate internucleotide linkage modification at position 21 of the antisense strand (counting from the 5'-end).

In some embodiments, the dsRNA molecule of the disclosure further comprises one phosphorothioate internucleotide linkage modification at position 1, and one phosphorothioate internucleotide linkage modification at position 21 of the sense strand (counting from the 5'-end), and two phosphorothioate internucleotide linkage modifications at positions 1 and 2 and two phosphorothioate internucleotide linkage modifications at positions 23 and 23 the antisense strand (counting from the 5'-end).

In some embodiments, compound of the disclosure comprises a pattern of backbone chiral centers. In some embodiments, a common pattern of backbone chiral centers comprises at least 5 internucleotidic linkages in the Sp configuration. In some embodiments, a common pattern of backbone chiral centers comprises at least 6 internucleotidic linkages in the Sp configuration. In some embodiments, a common pattern of backbone chiral centers comprises at least 7 internucleotidic linkages in the Sp configuration. In some embodiments, a common pattern of backbone chiral centers comprises at least 8 internucleotidic linkages in the Sp configuration. In some embodiments, a common pattern of backbone chiral centers comprises at least 9 internucleotidic linkages in the Sp configuration. In some embodiments, a common pattern of backbone chiral centers comprises at least 10 internucleotidic linkages in the Sp configuration. In some embodiments, a common pattern of backbone chiral centers comprises at least 11 internucleotidic linkages in the Sp configuration. In some embodiments, a common pattern of backbone chiral centers comprises at least 12 internucleotidic linkages in the Sp configuration. In some embodiments, a common pattern of backbone chiral centers comprises at least 13 internucleotidic linkages in the Sp configuration. In some embodiments, a common pattern of backbone chiral centers comprises at least 14 internucleotidic linkages in the Sp configuration. In some embodiments, a common pattern of backbone chiral centers comprises at least 15 internucleotidic linkages in the Sp configuration. In some embodiments, a common pattern of backbone chiral centers comprises at least 16 internucleotidic linkages in the Sp configuration. In some embodiments, a common pattern of backbone chiral centers comprises at least 17 internucleotidic linkages in the Sp configuration. In some embodiments, a common pattern of backbone chiral centers comprises at least 18 internucleotidic linkages in the Sp configuration. In some embodiments, a common pattern of backbone chiral centers comprises at least 19 internucleotidic linkages in the Sp configuration. In some embodiments, a common pattern of backbone chiral centers comprises no more than 8 internucleotidic linkages in the Rp configuration. In some embodiments, a common pattern of backbone chiral centers comprises no more than 7 internucleotidic linkages in the Rp configuration. In some embodiments, a common pattern of backbone chiral centers comprises no more than 6 internucleotidic linkages in the Rp configuration. In some embodiments, a common pattern of backbone chiral centers comprises no more than 5 internucleotidic linkages in the Rp configuration. In some embodiments, a common pattern of backbone chiral centers comprises no more than 4 internucleotidic linkages in the Rp configuration. In some embodiments, a common pattern of backbone chiral centers comprises no more than 3 internucleotidic linkages in the Rp configuration. In some embodiments, a common pattern of backbone chiral centers comprises no more than 2 internucleotidic linkages in the Rp configuration. In some embodiments, a common pattern of backbone chiral centers comprises no more than 1 internucleotidic linkages in the Rp configuration. In some embodiments, a common pattern of backbone chiral centers comprises no more than 8 internucleotidic linkages which are not chiral (as a non-limiting example, a phosphodiester). In some embodiments, a common pattern of backbone chiral centers comprises no more than 7 internucleotidic linkages which are not chiral. In some embodiments, a common pattern of backbone chiral centers comprises no more than 6 internucleotidic linkages which are not chiral. In some embodiments, a common pattern of backbone chiral centers comprises no more than 5 internucleotidic linkages which are not chiral. In some embodiments, a common pattern of backbone chiral centers comprises no more than 4 internucleotidic linkages which are not chiral. In some embodiments, a common pattern of backbone chiral centers comprises no more than 3 internucleotidic linkages which are not chiral. In some embodiments, a common pattern of backbone chiral centers comprises no more than 2 internucleotidic linkages which are not chiral. In some embodiments, a common pattern of backbone chiral centers comprises no more than 1 internucleotidic linkages which are not chiral. In some embodiments, a common pattern of backbone chiral centers comprises at least 10 internucleotidic linkages in the Sp configuration, and no more than 8 internucleotidic linkages which are not chiral. In some embodiments, a common pattern of backbone chiral centers comprises at least 11 internucleotidic linkages in the Sp configuration, and no more than 7 internucleotidic linkages which are not chiral. In some embodiments, a common pattern of backbone chiral centers comprises at least 12 internucleotidic linkages in the Sp configuration, and no more than 6 internucleotidic linkages which are not chiral. In some embodiments, a common pattern of backbone chiral centers comprises at least 13 internucleotidic linkages in the Sp configuration, and no more than 6 internucleotidic linkages which are not chiral. In some embodiments, a common pattern of backbone chiral centers comprises at least 14 internucleotidic linkages in the Sp configuration, and no more than 5 internucleotidic linkages which are not chiral. In some embodiments, a common pattern of backbone chiral centers comprises at least 15 internucleotidic linkages in the Sp configuration, and no more than 4 internucleotidic linkages which are not chiral. In some embodiments, the internucleotidic linkages in the Sp configuration are optionally contiguous or not contiguous. In some embodiments, the internucleotidic linkages in the Rp configuration are optionally contiguous or not contiguous. In some embodiments, the internucleotidic linkages which are not chiral are optionally contiguous or not contiguous.

In some embodiments, compound of the disclosure comprises a block is a stereochemistry block. In some embodiments, a block is an Rp block in that each internucleotidic linkage of the block is Rp. In some embodiments, a 5'-block is an Rp block. In some embodiments, a 3'-block is an Rp block. In some embodiments, a block is an Sp block in that each internucleotidic linkage of the block is Sp. In some embodiments, a 5'-block is an Sp block. In some embodiments, a 3'-block is an Sp block. In some embodiments, provided oligonucleotides comprise both Rp and Sp blocks. In some embodiments, provided oligonucleotides comprise one or more Rp but no Sp blocks. In some embodiments, provided oligonucleotides comprise one or more Sp but no Rp blocks. In some embodiments, provided oligonucleotides comprise one or more PO blocks wherein each internucleotidic linkage in a natural phosphate linkage.

In some embodiments, compound of the disclosure comprises a 5'-block is an Sp block wherein each sugar moiety comprises a 2'-F modification. In some embodiments, a 5'-block is an Sp block wherein each of internucleotidic linkage is a modified internucleotidic linkage and each sugar moiety comprises a 2'-F modification. In some embodiments, a 5'-block is an Sp block wherein each of internucleotidic linkage is a phosphorothioate linkage and each sugar moiety comprises a 2'-F modification. In some embodiments, a 5'-block comprises 4 or more nucleoside units. In some embodiments, a 5'-block comprises 5 or more nucleoside units. In some embodiments, a 5'-block comprises 6 or more nucleoside units. In some embodiments, a 5'-block comprises 7 or more nucleoside units. In some embodiments, a 3'-block is an Sp block wherein each sugar moiety comprises a 2'-F modification. In some embodiments, a 3'-block is an Sp block wherein each of internucleotidic linkage is a modified internucleotidic linkage and each sugar moiety comprises a 2'-F modification. In some embodiments, a 3'-block is an Sp block wherein each of internucleotidic linkage is a phosphorothioate linkage and each sugar moiety comprises a 2'-F modification. In some embodiments, a 3'-block comprises 4 or more nucleoside units. In some embodiments, a 3'-block comprises 5 or more nucleoside units. In some embodiments, a 3'-block comprises 6 or more nucleoside units. In some embodiments, a 3'-block comprises 7 or more nucleoside units.

In some embodiments, compound of the disclosure comprises a type of nucleoside in a region or an oligonucleotide is followed by a specific type of internucleotidic linkage, e.g., natural phosphate linkage, modified internucleotidic linkage, Rp chiral internucleotidic linkage, Sp chiral internucleotidic linkage, etc. In some embodiments, A is followed by Sp. In some embodiments, A is followed by Rp. In some embodiments, A is followed by natural phosphate linkage (PO). In some embodiments, U is followed by Sp. In some embodiments, U is followed by Rp. In some embodiments, U is followed by natural phosphate linkage (PO). In some embodiments, C is followed by Sp. In some embodiments, C is followed by Rp. In some embodiments, C is followed by natural phosphate linkage (PO). In some embodiments, G is followed by Sp. In some embodiments, G is followed by Rp. In some embodiments, G is followed by natural phosphate linkage (PO). In some embodiments, C and U are followed by Sp. In some embodiments, C and U are followed by Rp. In some embodiments, C and U are followed by natural phosphate linkage (PO). In some embodiments, A and G are followed by Sp. In some embodiments, A and G are followed by Rp.

In some embodiments, the dsRNA molecule of the disclosure comprises mismatch(es) with the target, within the duplex, or combinations thereof. The mismatch can occur in the overhang region or the duplex region. The base pair can be ranked on the basis of their propensity to promote dissociation or melting (e.g., on the free energy of association or dissociation of a particular pairing, the simplest approach is to examine the pairs on an individual pair basis, though next neighbor or similar analysis can also be used). In terms of promoting dissociation: A:U is preferred over G:C; G:U is preferred over G:C; and I:C is preferred over G:C (I=inosine). Mismatches, e.g., non-canonical or other than canonical pairings (as described elsewhere herein) are preferred over canonical (A:T, A:U, G:C) pairings; and pairings which include a universal base are preferred over canonical pairings.

In some embodiments, the dsRNA molecule of the disclosure comprises at least one of the first 1, 2, 3, 4, or 5 base pairs within the duplex regions from the 5'-end of the antisense strand can be chosen independently from the group of: A:U, G:U, I:C, and mismatched pairs, e.g., non-canonical or other than canonical pairings or pairings which include a universal base, to promote the dissociation of the antisense strand at the 5'-end of the duplex.

In some embodiments, the nucleotide at the 1 position within the duplex region from the 5'-end in the antisense strand is selected from the group consisting of A, dA, dU, U, and dT. Alternatively, at least one of the first 1, 2 or 3 base pair within the duplex region from the 5'-end of the antisense strand is an AU base pair. For example, the first base pair within the duplex region from the 5'-end of the antisense strand is an AU base pair.

It was found that introducing 4'-modified or 5'-modified nucleotide to the 3'-end of a phosphodiester (PO), phosphorothioate (PS), or phosphorodithioate (PS2) linkage of a dinucleotide at any position of single stranded or double stranded oligonucleotide can exert steric effect to the internucleotide linkage and, hence, protecting or stabilizing it against nucleases.

In some embodiments, 5'-modified nucleoside is introduced at the 3'-end of a dinucleotide at any position of single stranded or double stranded siRNA. For instance, a 5'-alkylated nucleoside may be introduced at the 3'-end of a dinucleotide at any position of single stranded or double stranded siRNA. The alkyl group at the 5' position of the ribose sugar can be racemic or chirally pure R or S isomer. An exemplary 5'-alkylated nucleoside is 5'-methyl nucleoside. The 5'-methyl can be either racemic or chirally pure R or S isomer.

In some embodiments, 4'-modified nucleoside is introduced at the 3'-end of a dinucleotide at any position of single stranded or double stranded siRNA. For instance, a 4'-alkylated nucleoside may be introduced at the 3'-end of a dinucleotide at any position of single stranded or double stranded siRNA. The alkyl group at the 4' position of the ribose sugar can be racemic or chirally pure R or S isomer. An exemplary 4'-alkylated nucleoside is 4'-methyl nucleoside. The 4'-methyl can be either racemic or chirally pure R or S isomer. Alternatively, a 4'-O-alkylated nucleoside may be introduced at the 3'-end of a dinucleotide at any position of single stranded or double stranded siRNA. The 4'-O-alkyl of the ribose sugar can be racemic or chirally pure R or S isomer. An exemplary 4'-O-alkylated nucleoside is 4'-O-methyl nucleoside. The 4'-O-methyl can be either racemic or chirally pure R or S isomer.

In some embodiments, 5'-alkylated nucleoside is introduced at any position on the sense strand or antisense strand of a dsRNA, and such modification maintains or improves potency of the dsRNA. The 5'-alkyl can be either racemic or chirally pure R or S isomer. An exemplary 5'-alkylated nucleoside is 5'-methyl nucleoside. The 5'-methyl can be either racemic or chirally pure R or S isomer.

In some embodiments, 4'-alkylated nucleoside is introduced at any position on the sense strand or antisense strand of a dsRNA, and such modification maintains or improves potency of the dsRNA. The 4'-alkyl can be either racemic or chirally pure R or S isomer. An exemplary 4'-alkylated nucleoside is 4'-methyl nucleoside. The 4'-methyl can be either racemic or chirally pure R or S isomer.

In some embodiments, 4'-O-alkylated nucleoside is introduced at any position on the sense strand or antisense strand of a dsRNA, and such modification maintains or improves potency of the dsRNA. The 5'-alkyl can be either racemic or chirally pure R or S isomer. An exemplary 4'-O-alkylated nucleoside is 4'-O-methyl nucleoside. The 4'-O-methyl can be either racemic or chirally pure R or S isomer.

In some embodiments, the dsRNA molecule of the disclosure can comprise 2'-5' linkages (with 2'-H, 2'-OH, and 2'-OMe and with P═O or P═S). For example, the 2'-5' linkages modifications can be used to promote nuclease resistance or to inhibit binding of the sense to the antisense strand, or can be used at the 5' end of the sense strand to avoid sense strand activation by RISC.

In other embodiments, the dsRNA molecule of the disclosure can comprise L sugars (e.g., L ribose, L-arabinose with 2'-H, 2'-OH and 2'-OMe). For example, these L sugars modifications can be used to promote nuclease resistance or to inhibit binding of the sense to the antisense strand, or can be used at the 5' end of the sense strand to avoid sense strand activation by RISC.

Various publications describe multimeric siRNA which can all be used with the dsRNA of the disclosure. Such publications include WO2007/091269, U.S. Pat. No. 7,858,769, WO2010/141511, WO2007/117686, WO2009/014887, and WO2011/031520 which are hereby incorporated by their entirely.

In some embodiments dsRNA molecules of the disclosure are 5' phosphorylated or include a phosphoryl analog at the 5' prime terminus. 5'-phosphate modifications include those which are compatible with RISC mediated gene silencing. Suitable modifications include: 5'-monophosphate ($(HO)_2$(O)P—O-5'); 5'-diphosphate ($(HO)_2$(O)P—O-P(HO)(O)-O-5'); 5'-triphosphate ($(HO)_2$(O)P—O-(HO)(O)P—O—P(HO)(O)-O-5'); 5'-guanosine cap (7-methylated or non-methylated) (7m-G-O-5'-(HO)(O)P-O—(HO)(O)P—O-P(HO)(O)-O-5'); 5'-adenosine cap (Appp), and any modified or unmodified nucleotide cap structure (N-O-5'-(HO)(O)P-O—(HO)(O)P—O-P(HO)(O)-O-5'); 5'-monothiophosphate (phosphorothioate; $(HO)_2$(S)P-O-5'); 5'-monodithiophosphate (phosphorodithioate; (HO)(HS)(S)P—O-5'), 5'-phosphorothiolate ($(HO)_2$(O)P-S-5'); any additional combination of oxygen/sulfur replaced monophosphate, diphosphate and triphosphates (e.g. 5'-alpha-thiotriphosphate, 5'-gamma-thiotriphosphate, etc.), 5'-phosphoramidates ((HO)2(O)P-NH-5', (HO)(NH2)(O)P—O-5'), 5'-alkylphosphonates (R=alkyl=methyl, ethyl, isopropyl, propyl, etc., e.g. RP(OH)(O)-O-5'-, 5'-alkenylphosphonates (i.e. vinyl, substituted vinyl), $(OH)_2$(O)P-5'-CH2-), 5'-alkyletherphosphonates (R=alkylether=methoxymethyl (MeOCH2-), ethoxymethyl, etc., e.g. RP(OH)(O)-O-5'-). In one example, the modification can in placed in the antisense strand of a dsRNA molecule.

Linkers

In some embodiments, the conjugate or ligand described herein can be attached to an iRNA oligonucleotide with various linkers that can be cleavable or non-cleavable.

Linkers typically comprise a direct bond or an atom such as oxygen or sulfur, a unit such as NR8, C(O), C(O)NH, SO, $SO_2$, $SO_2NH$ or a chain of atoms, such as, but not limited to, substituted or unsubstituted alkyl, substituted or unsubstituted alkenyl, substituted or unsubstituted alkynyl, arylalkyl, arylalkenyl, arylalkynyl, heteroarylalkyl, heteroarylalkenyl, heteroarylalkynyl, heterocyclylalkyl, heterocyclylalkenyl, heterocyclylalkynyl, aryl, heteroaryl, heterocyclyl, cycloalkyl, cycloalkenyl, alkylarylalkyl, alkylarylalkenyl, alkylarylalkynyl, alkenylarylalkyl, alkenylarylalkenyl, alkenylarylalkynyl, alkynylarylalkyl, alkynylarylalkenyl, alkynylarylalkynyl, alkylheteroarylalkyl, alkylheteroarylalkenyl, alkylheteroarylalkynyl, alkenylheteroarylalkyl, alkenylheteroarylalkenyl, alkenylheteroarylalkynyl, alkynylheteroarylalkyl, alkynylheteroarylalkenyl, alkynylheteroarylalkynyl, alkylheterocyclylalkyl, alkylheterocyclylalkenyl, alkylhererocyclylalkynyl, alkenylheterocyclylalkyl, alkenylheterocyclylalkenyl, alkenylheterocyclylalkynyl, alkynylheterocyclylalkyl, alkynylheterocyclylalkenyl, alkynylheterocyclylalkynyl, alkylaryl, alkenylaryl, alkynylaryl, alkylheteroaryl, alkenylheteroaryl, alkynylhereroaryl, which one or more methylenes can be interrupted or terminated by O, S, S(O), $SO_2$, N(R8), C(O), substituted or unsubstituted aryl, substituted or unsubstituted heteroaryl, substituted or unsubstituted heterocyclic; where R8 is hydrogen, acyl, aliphatic or substituted aliphatic. In some embodiments, the linker is between about 1-24 atoms, 2-24, 3-24, 4-24, 5-24, 6-24, 6-18, 7-18, 8-18 atoms, 7-17, 8-17, 6-16, 7-16, or 8-16 atoms.

In some embodiments, a dsRNA of the disclosure is conjugated to a bivalent or trivalent branched linker selected from the group of structures shown in any of formula (XXXI)-(XXXIV):

Formula XXXI

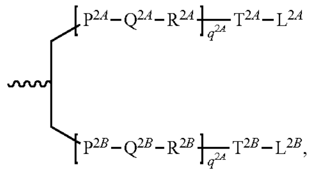

Formula XXXII

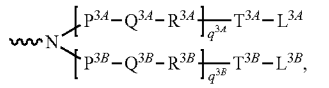

Formula XXXIII

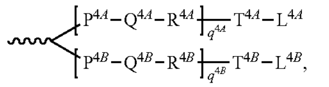

Formula XXXIV

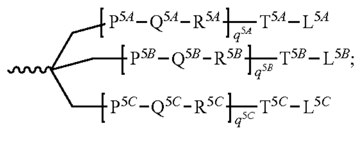

wherein:

q2A, q2B, q3A, q3B, q4A, q4B, q5A, q5B and q5C represent independently for each occurrence 0-20 and wherein the repeating unit can be the same or different;

$P^{2A}$, $P^{2B}$, $P^{3A}$, $P^{3B}$, $P^{4A}$, $P^{4B}$, $P^{5A}$, $P^{5B}$, $P^{5C}$, $T^{2A}$, $T^{2B}$, $T^{3A}$, $T^{3B}$, $T^{4A}$, $T^{4B}$, $T^{4A}$, $T^{5B}$, $T^{5C}$ are each independently for each occurrence absent, CO, NH, O, S, OC(O), NHC(O), $CH_2$, $CH_2NH$ or $CH_2O$;

$Q^{2A}$, $Q^{2B}$, $Q^{3A}$, $Q^{3B}$, $Q^{4A}$, $Q^{4B}$, $Q^{5A}$, $Q^{5B}$, $Q^{5C}$ are independently for each occurrence absent, alkylene, substituted alkylene wherein one or more methylenes can be interrupted or terminated by one or more of O, S, S(O), $SO_2$, $N(R^N)$, C(R')=C(R"), C≡C or C(O);

$R^{2A}$, $R^{2B}$, $R^{3A}$, $R^{3B}$, $R^{4A}$, $R^{4B}$, $R^{5A}$, $R^{5B}$, $R^{5C}$ are each independently for each occurrence absent, NH, O, S, $CH_2$, C(O)O, C(O)NH, $NHCH(R^a)C(O)$, $-C(O)-CH(R^a)-NH-$, CO, CH=N-O,

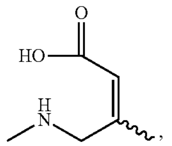,
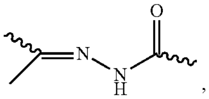,
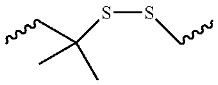,
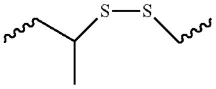,
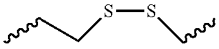

or heterocyclyl;

$L^{2A}$, $L^{2B}$, $L^{3A}$, $L^{3B}$, $L^{4A}$, $L^{4B}$, $L^{5A}$, $L^{5B}$ and $L^{5C}$ represent the ligand; i.e. each independently for each occurrence a monosaccharide (such as GalNAc), disaccharide, trisaccharide, tetrasaccharide, oligosaccharide, or polysaccharide; and $R^a$ is H or amino acid side chain. Trivalent conjugating GalNAc derivatives are particularly useful for use with RNAi agents for inhibiting the expression of a target gene, such as those of formula (XXXV):

Formula XXXV

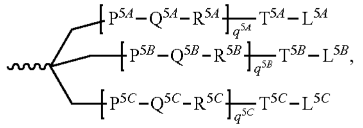

wherein $L^{5A}$, $L^{5B}$ and $L^{5C}$ represent a monosaccharide, such as GalNAc derivative.

Examples of suitable bivalent and trivalent branched linker groups conjugating GalNAc derivatives include, but are not limited to, the structures recited above as formulas II, VII, XI, X, and XIII.

A cleavable linking group is one which is sufficiently stable outside the cell, but which upon entry into a target cell is cleaved to release the two parts the linker is holding together. In a some embodiments, the cleavable linking group is cleaved at least about 10 times, 20, times, 30 times, 40 times, 50 times, 60 times, 70 times, 80 times, 90 times or more, or at least about 100 times faster in a target cell or under a first reference condition (which can, e.g., be selected to mimic or represent intracellular conditions) than in the blood of a subject, or under a second reference condition (which can, e.g., be selected to mimic or represent conditions found in the blood or serum).

Cleavable linking groups are susceptible to cleavage agents, e.g., pH, redox potential or the presence of degradative molecules. Generally, cleavage agents are more prevalent or found at higher levels or activities inside cells than in serum or blood. Examples of such degradative agents include: redox agents which are selected for particular substrates or which have no substrate specificity, including, e.g., oxidative or reductive enzymes or reductive agents such as mercaptans, present in cells, that can degrade a redox cleavable linking group by reduction; esterases; endosomes or agents that can create an acidic environment, e.g., those that result in a pH of five or lower; enzymes that can hydrolyze or degrade an acid cleavable linking group by acting as a general acid, peptidases (which can be substrate specific), and phosphatases.

A cleavable linkage group, such as a disulfide bond can be susceptible to pH. The pH of human serum is 7.4, while the average intracellular pH is slightly lower, ranging from about 7.1-7.3. Endosomes have a more acidic pH, in the range of 5.5-6.0, and lysosomes have an even more acidic pH at around 5.0. Some linkers will have a cleavable linking group that is cleaved at a suitable pH, thereby releasing a cationic lipid from the ligand inside the cell, or into the desired compartment of the cell.

A linker can include a cleavable linking group that is cleavable by a particular enzyme. The type of cleavable linking group incorporated into a linker can depend on the cell to be targeted.

In general, the suitability of a candidate cleavable linking group can be evaluated by testing the ability of a degradative agent (or condition) to cleave the candidate linking group. It will also be desirable to also test the candidate cleavable linking group for the ability to resist cleavage in the blood or when in contact with other non-target tissue. Thus, one can determine the relative susceptibility to cleavage between a first and a second condition, where the first is selected to be indicative of cleavage in a target cell and the second is selected to be indicative of cleavage in other tissues or biological fluids, e.g., blood or serum. The evaluations can be carried out in cell free systems, in cells, in cell culture, in organ or tissue culture, or in whole animals. It can be useful to make initial evaluations in cell-free or culture conditions and to confirm by further evaluations in whole animals. In some embodiments, useful candidate compounds are cleaved at least about 2, 4, 10, 20, 30, 40, 50, 60, 70, 80, 90, or about 100 times faster in the cell (or under in vitro conditions selected to mimic intracellular conditions) as compared to blood or serum (or under in vitro conditions selected to mimic extracellular conditions).

Redox Cleavable Linking Groups

In some embodiments, a cleavable linking group is a redox cleavable linking group that is cleaved upon reduction or oxidation. An example of reductively cleavable linking group is a disulphide linking group (—S—S—). To determine if a candidate cleavable linking group is a suitable "reductively cleavable linking group," or for example is suitable for use with a particular iRNA moiety and particular targeting agent one can look to methods described herein. For example, a candidate can be evaluated by incubation with dithiothreitol (DTT), or other reducing agent using reagents know in the art, which mimic the rate of cleavage which would be observed in a cell, e.g., a target cell. The candidates can also be evaluated under conditions which are selected to mimic blood or serum conditions. In one, candidate compounds are cleaved by at most about 10% in the blood. In other embodiments, useful candidate compounds are degraded at least about 2, 4, 10, 20, 30, 40, 50, 60, 70, 80, 90, or about 100 times faster in the cell (or under in vitro conditions selected to mimic intracellular conditions) as compared to blood (or under in vitro conditions selected to mimic extracellular conditions). The rate of cleavage of candidate compounds can be determined using standard enzyme kinetics assays under conditions chosen to mimic intracellular media and compared to conditions chosen to mimic extracellular media.

Phosphate-Based Cleavable Linking Groups

In some embodiments, a cleavable linker comprises a phosphate-based cleavable linking group. A phosphate-based cleavable linking group is cleaved by agents that degrade or hydrolyze the phosphate group. An example of an agent that cleaves phosphate groups in cells are enzymes such as phosphatases in cells. Examples of phosphate-based linking groups are —O—P(O)(ORk)-O—, —O—P(S)(ORk)-O—, —O—P(S)(SRk)-O—, —S—P(O)(ORk)-O—, —O—P(O)(ORk)-S—, —S—P(O)(ORk)-S—, —O—P(S)(ORk)-S—, —S—P(S)(ORk)-O—, —O-P(O)(Rk)-O—, —O—P(S)(Rk)-O—, —S—P(O)(Rk)-O—, —S—P(S)(Rk)-O—, —S—P(O)(Rk)-S—, —O—P(S)(Rk)-S—, wherein Rk at each occurrence can be, independently, C1-C20 alkyl, C1-C20 haloalkyl, C6-C10 aryl, or C7-C12 aralkyl. In some embodiments, phosphate-based linking groups are —O—P(O)(OH)—O—, —O—P(S)(OH)—O—, —O—P(S)(SH)—O—, —S—P(O)(OH)—O—, —O—P(O)(OH)—S—, —S—P(O)(OH)—S—, —O—P(S)(OH)—S—, —S—P(S)(OH)—O—, —O—P(O)(H)—O—, —O—P(S)(H)—O—, —S—P(O)(H)—O, —S—P(S)(H)—O—, —S—P(O)(H)—S—, —O—P(S)(H)—S—. In some embodiments, a phosphate-based linking group is —O—P(O)(OH)—O—. These candidates can be evaluated using methods analogous to those described above.

Acid Cleavable Linking Groups

In some embodiments, a cleavable linker comprises an acid cleavable linking group. An acid cleavable linking group is a linking group that is cleaved under acidic conditions. In some embodiments acid cleavable linking groups are cleaved in an acidic environment with a pH of about 6.5 or lower (e.g., about 6.0, 5.75, 5.5, 5.25, 5.0, or lower), or by agents such as enzymes that can act as a general acid. In a cell, specific low pH organelles, such as endosomes and lysosomes can provide a cleaving environment for acid cleavable linking groups. Examples of acid cleavable linking groups include but are not limited to hydrazones, esters, and esters of amino acids. Acid cleavable groups can have the general formula —C═NN—, C(O)O, or —OC(O). In some embodiments, the carbon attached to the oxygen of the ester (the alkoxy group) is an aryl group, substituted alkyl group, or tertiary alkyl group such as dimethyl pentyl or t-butyl. These candidates can be evaluated using methods analogous to those described above.

Ester-Based Cleavable Linking Groups

In some embodiments, a cleavable linker comprises an ester-based cleavable linking group. An ester-based cleavable linking group is cleaved by enzymes such as esterases and amidases in cells. Examples of ester-based cleavable linking groups include but are not limited to esters of alkylene, alkenylene and alkynylene groups. Ester cleavable linking groups have the general formula —C(O)O—, or —OC(O)—. These candidates can be evaluated using methods analogous to those described above.

Peptide-Based Cleavable Linking Groups

In some embodiments, a cleavable linker comprises a peptide-based cleavable linking group. A peptide-based cleavable linking group is cleaved by enzymes such as peptidases and proteases in cells. Peptide-based cleavable linking groups are peptide bonds formed between amino acids to yield oligopeptides (e.g., dipeptides, tripeptides etc.) and polypeptides. Peptide-based cleavable groups do not include the amide group (—C(O)NH—). The amide group can be formed between any alkylene, alkenylene or alkynelene. A peptide bond is a special type of amide bond formed between amino acids to yield peptides and proteins. The peptide-based cleavage group is generally limited to the peptide bond (i.e., the amide bond) formed between amino acids yielding peptides and proteins and does not include the entire amide functional group. Peptide-based cleavable linking groups have the general formula —NHCHRAC(O)NHCHRBC(O)—, where RA and RB are the R groups of the two adjacent amino acids. These candidates can be evaluated using methods analogous to those described above. Representative U.S. patents that teach the preparation of RNA conjugates include, but are not limited to, U.S. Pat. Nos. 4,828,979; 4,948,882; 5,218,105; 5,525,465; 5,541,313; 5,545,730; 5,552,538; 5,578,717, 5,580,731; 5,591,584; 5,109,124; 5,118,802; 5,138,045; 5,414,077; 5,486,603; 5,512,439; 5,578,718; 5,608,046; 4,587,044; 4,605,735; 4,667,025; 4,762,779; 4,789,737; 4,824,941; 4,835,263; 4,876,335; 4,904,582; 4,958,013; 5,082,830; 5,112,963; 5,214,136; 5,082,830; 5,112,963; 5,214,136; 5,245,022; 5,254,469; 5,258,506; 5,262,536; 5,272,250; 5,292,873; 5,317,098; 5,371,241, 5,391,723; 5,416,203, 5,451,463; 5,510,475; 5,512,667; 5,514,785; 5,565,552; 5,567,810; 5,574,142; 5,585,481; 5,587,371; 5,595,726; 5,597,696; 5,599,923; 5,599,928 and 5,688,941; 6,294,664; 6,320,017; 6,576,752; 6,783,931; 6,900,297; 7,037,646; 8,106,022, the entire contents of each of which is herein incorporated by reference.

It is not necessary for all positions in a given compound to be uniformly modified, and in fact more than one of the aforementioned modifications may be incorporated in a single compound or even at a single nucleoside within an iRNA. The present disclosure also includes iRNA compounds that are chimeric compounds.

"Chimeric" iRNA compounds, or "chimeras," in the context of the present disclosure, are iRNA compounds, e.g., dsRNAs, that contain two or more chemically distinct regions, each made up of at least one monomer unit, i.e., a nucleotide in the case of a dsRNA compound. These iRNAs typically contain at least one region wherein the RNA is modified so as to confer upon the iRNA increased resistance to nuclease degradation, increased cellular uptake, and/or increased binding affinity for the target nucleic acid. An additional region of the iRNA may serve as a substrate for enzymes capable of cleaving RNA:DNA or RNA:RNA hybrids. By way of example, RNase H is a cellular endonuclease which cleaves the RNA strand of an RNA:DNA duplex. Activation of RNase H, therefore, results in cleavage of the RNA target, thereby greatly enhancing the efficiency of iRNA inhibition of gene expression. Consequently, comparable results can often be obtained with shorter iRNAs when chimeric dsRNAs are used, compared to phosphorothioate deoxy dsRNAs hybridizing to the same target region. Cleavage of the RNA target can be routinely detected by gel electrophoresis and, if necessary, associated nucleic acid hybridization techniques known in the art.

In certain instances, the RNA of an iRNA can be modified by a non-ligand group. A number of non-ligand molecules have been conjugated to iRNAs in order to enhance the activity, cellular distribution or cellular uptake of the iRNA, and procedures for performing such conjugations are available in the scientific literature. Such non-ligand moieties have included lipid moieties, such as cholesterol (Kubo, T. et al., *Biochem. Biophys. Res. Comm.,* 2007, 365(1):54-61; Letsinger et al., *Proc. Natl. Acad. Sci. USA,* 1989, 86:6553), cholic acid (Manoharan et al., *Bioorg. Med. Chem. Lett.,* 1994, 4:1053), a thioether, e.g., hexyl-S-tritylthiol (Manoharan et al., *Ann. N.Y. Acad. Sci.,* 1992, 660:306; Manoharan et al., *Bioorg. Med. Chem. Let.,* 1993, 3:2765), a thiocholesterol (Oberhauser et al., *Nucl. Acids Res.,* 1992, 20:533), an aliphatic chain, e.g., dodecandiol or undecyl residues (Saison-Behmoaras et al., *EMBO J.,* 1991, 10:111; Kabanov et al., *FEBS Lett.,* 1990, 259:327; Svinarchuk et al., *Biochimie,* 1993, 75:49), a phospholipid, e.g., di-hexadecyl-rac-glycerol or triethylammonium 1,2-di-O-hexadecyl-rac-glycero-3-H-phosphonate (Manoharan et al., *Tetrahedron Lett.,* 1995, 36:3651; Shea et al., *Nucl. Acids Res.,* 1990, 18:3777), a polyamine or a polyethylene glycol chain (Manoharan et al., *Nucleosides & Nucleotides,* 1995, 14:969), or adamantane acetic acid (Manoharan et al., *Tetrahedron Lett.,* 1995, 36:3651), a palmityl moiety (Mishra et al., *Biochim. Biophys. Acta,* 1995, 1264:229), or an octadecylamine or hexylamino-carbonyl-oxycholesterol moiety (Crooke et al., *J. Pharmacol. Exp. Ther.,* 1996, 277:923). Representative United States patents that teach the preparation of such RNA conjugates have been listed above. Typical conjugation protocols involve the synthesis of an RNAs bearing an aminolinker at one or more positions of the sequence. The amino group is then reacted with the molecule being conjugated using appropriate coupling or activating reagents. The conjugation reaction may be performed either with the RNA still bound to the solid support or following cleavage of the RNA, in solution phase. Purification of the RNA conjugate by HPLC typically affords the pure conjugate.

Delivery of iRNA

The delivery of an iRNA to a subject in need thereof can be achieved in a number of different ways. In vivo delivery can be performed directly by administering a composition comprising an iRNA, e.g. a dsRNA, to a subject. Alternatively, delivery can be performed indirectly by administering one or more vectors that encode and direct the expression of the iRNA. These alternatives are discussed further below.

Direct Delivery

In general, any method of delivering a nucleic acid molecule can be adapted for use with an iRNA (see e.g., Akhtar S. and Julian R L. (1992) *Trends Cell. Biol.* 2(5): 139-144 and WO94/02595, which are incorporated herein by reference in their entireties). However, there are three factors that are important to consider in order to successfully deliver an iRNA molecule in vivo: (1) biological stability of the delivered molecule, (2) preventing non-specific effects, and (3) accumulation of the delivered molecule in the target tissue. The non-specific effects of an iRNA can be minimized by local administration, for example by direct injection or implantation into a tissue (as a non-limiting example, the spine) or topically administering the preparation. Local administration to a treatment site maximizes local concentration of the agent, limits the exposure of the agent to systemic tissues that may otherwise be harmed by the agent or that may degrade the agent, and permits a lower total dose of the iRNA molecule to be administered. Several studies have shown successful knockdown of gene products when an iRNA is administered locally. For example, intraocular delivery of a VEGF dsRNA by intravitreal injection in cynomolgus monkeys (Tolentino, M J., et al (2004) *Retina* 24:132-138) and subretinal injections in mice (Reich, S J., et al (2003) *Mol. Vis.* 9:210-216) were both shown to prevent neovascularization in an experimental model of age-related macular degeneration. In addition, direct intratumoral injection of a dsRNA in mice reduces tumor volume (Pille, J., et al (2005) *Mol. Ther.* 11:267-274) and can prolong survival of tumor-bearing mice (Kim, W J., et al (2006) *Mol. Ther.* 14:343-350; Li, S., et al (2007) *Mol. Ther.* 15:515-523). RNA interference has also shown success with local delivery to the CNS by direct injection (Dorn, G., et al. (2004) *Nucleic Acids* 32:e49; Tan, P H., et al (2005) *Gene Ther.* 12:59-66; Makimura, H., et al (2002) *BMC Neurosci.* 3:18; Shishkina, G T., et al (2004) *Neuroscience* 129:521-528; Thakker, E R., et al (2004) *Proc. Natl. Acad. Sci. U.S.A.* 101:17270-17275; Akaneya, Y., et al (2005) *J. Neurophysiol.* 93:594-602) and to the lungs by intranasal administration (Howard, K A., et al (2006) *Mol. Ther.* 14:476-484; Zhang, X., et al (2004) *J. Biol. Chem.* 279:10677-10684; Bitko, V., et al (2005) *Nat. Med.* 11:50-55). For administering an iRNA systemically for the treatment of a disease, the RNA can be modified or alternatively delivered using a drug delivery system; both methods act to prevent the rapid degradation of the dsRNA by endo- and exo-nucleases in vivo.

Modification of the RNA or the pharmaceutical carrier can also permit targeting of the iRNA composition to the target tissue and avoid undesirable off-target effects. iRNA molecules can be modified by chemical conjugation to other groups, e.g., a lipid or carbohydrate group as described herein. Such conjugates can be used to target iRNA to particular cells, e.g., liver cells, e.g., hepatocytes. For example, GalNAc conjugates or lipid (e.g., LNP) formulations can be used to target iRNA to particular cells, e.g., liver cells, e.g., hepatocytes.

iRNA molecules can also be modified by chemical conjugation to lipophilic groups such as cholesterol to enhance cellular uptake and prevent degradation. For example, an iRNA directed against ApoB conjugated to a lipophilic cholesterol moiety was injected systemically into mice and resulted in knockdown of apoB mRNA in both the liver and jejunum (Soutschek, J., et al (2004) *Nature* 432:173-178). Conjugation of an iRNA to an aptamer has been shown to inhibit tumor growth and mediate tumor regression in a mouse model of prostate cancer (McNamara, J O., et al (2006) *Nat. Biotechnol.* 24:1005-1015). In an alternative embodiment, the iRNA can be delivered using drug delivery systems such as a nanoparticle, a dendrimer, a polymer, liposomes, or a cationic delivery system. Positively charged cationic delivery systems facilitate binding of an iRNA molecule (negatively charged) and also enhance interactions at the negatively charged cell membrane to permit efficient uptake of an iRNA by the cell. Cationic lipids, dendrimers, or polymers can either be bound to an iRNA, or induced to form a vesicle or micelle (see e.g., Kim S H., et al (2008) *Journal of Controlled Release* 129(2):107-116) that encases an iRNA. The formation of vesicles or micelles further prevents degradation of the iRNA when administered systemically. Methods for making and administering cationic-iRNA complexes are well within the abilities of one skilled in the art (see e.g., Sorensen, D R., et al (2003) *J. Mol. Biol* 327:761-766; Verma, U N., et al (2003) *Clin. Cancer Res.* 9:1291-1300; Arnold, A S et al (2007) *J. Hypertens.* 25:197-205, which are incorporated herein by reference in their entirety). Some non-limiting examples of drug delivery systems useful for systemic delivery of iRNAs include DOTAP (Sorensen, D R., et al (2003), supra; Verma, U N., et al (2003), supra), Oligofectamine, "solid nucleic acid lipid particles" (Zimmermann, T S., et al (2006) *Nature* 441:111-114), cardiolipin (Chien, P Y., et al (2005) *Cancer Gene Ther.* 12:321-328; Pal, A., et al (2005) *Int J. Oncol.* 26:1087-1091), polyethyleneimine (Bonnet M E., et al (2008) *Pharm. Res.* August 16 Epub ahead of print; Aigner, A. (2006) *J. Biomed. Biotechnol.* 71659), Arg-Gly-Asp (RGD) peptides (Liu, S. (2006) *Mol. Pharm.* 3:472-487), and polyamidoamines (Tomalia, D A., et al (2007) *Biochem. Soc. Trans.* 35:61-67; Yoo, H., et al (1999) *Pharm. Res.* 16:1799-1804). In some embodiments, an iRNA forms a complex with cyclodextrin for systemic administration. Methods for administration and pharmaceutical compositions of iRNAs and cyclodextrins can be found in U.S. Pat. No. 7,427,605, which is herein incorporated by reference in its entirety.

Vector Encoded iRNAs

In some embodiments, iRNA targeting SCN9A can be expressed from transcription units inserted into DNA or RNA vectors (see, e.g., Couture, A, et al., *TIG.* (1996), 12:5-10; Skillern, A., et al., International PCT Publication No. WO 00/22113, Conrad, International PCT Publication No. WO 00/22114, and Conrad, U.S. Pat. No. 6,054,299). Expression can be transient (on the order of hours to weeks) or sustained (weeks to months or longer), depending upon the specific construct used and the target tissue or cell type. These transgenes can be introduced as a linear construct, a circular plasmid, or a viral vector, which can be an integrating or non-integrating vector. The transgene can also be constructed to permit it to be inherited as an extrachromosomal plasmid (Gassmann, et al., *Proc. Natl. Acad. Sci. USA* (1995) 92:1292).

The individual strand or strands of an iRNA can be transcribed from a promoter on an expression vector. Where two separate strands are to be expressed to generate, for example, a dsRNA, two separate expression vectors can be co-introduced (e.g., by transfection or infection) into a target cell. Alternatively, each individual strand of a dsRNA can be transcribed by promoters both of which are located on the same expression plasmid. In some embodiments, a dsRNA is expressed as an inverted repeat joined by a linker polynucleotide sequence such that the dsRNA has a stem and loop structure.

An iRNA expression vector is typically a DNA plasmid or viral vector. An expression vector compatible with eukaryotic cells, e.g., with vertebrate cells, can be used to produce recombinant constructs for the expression of an iRNA as described herein. Eukaryotic cell expression vectors are well known in the art and are available from a number of commercial sources. Typically, such vectors contain convenient restriction sites for insertion of the desired nucleic acid segment. Delivery of iRNA expressing vectors can be systemic, such as by intravenous or intramuscular administration, by administration to target cells ex-planted from the patient followed by reintroduction into the patient, or by any other means that allows for introduction into a desired target cell.

An iRNA expression plasmid can be transfected into a target cell as a complex with a cationic lipid carrier (e.g., Oligofectamine) or a non-cationic lipid-based carrier (e.g., Transit-TKO™). Multiple lipid transfections for iRNA-mediated knockdowns targeting different regions of a target RNA over a period of a week or more are also contemplated by the disclosure. Successful introduction of vectors into host cells can be monitored using various known methods. For example, transient transfection can be signaled with a reporter, such as a fluorescent marker, such as Green Fluorescent Protein (GFP). Stable transfection of cells ex vivo can be ensured using markers that provide the transfected cell with resistance to specific environmental factors (e.g., antibiotics and drugs), such as hygromycin B resistance.

Viral vector systems which can be utilized with the methods and compositions described herein include, but are not limited to, (a) adenovirus vectors; (b) retrovirus vectors, including but not limited to lentiviral vectors, moloney murine leukemia virus, etc.; (c) adeno-associated virus vectors; (d) herpes simplex virus vectors; (e) SV40 vectors; (f) polyoma virus vectors; (g) papilloma virus vectors; (h) picornavirus vectors; (i) pox virus vectors such as an orthopox, e.g., vaccinia virus vectors or avipox, e.g. canary pox or fowl pox; and (j) a helper-dependent or gutless adenovirus. Replication-defective viruses can also be advantageous. Different vectors will or will not become incorporated into the cells' genome. The constructs can include viral sequences for transfection, if desired. Alternatively, the construct may be incorporated into vectors capable of episomal replication, e.g EPV and EBV vectors. Constructs for the recombinant expression of an iRNA will generally require regulatory elements, e.g., promoters, enhancers, etc., to ensure the expression of the iRNA in target cells. Other aspects to consider for vectors and constructs are further described below.

Vectors useful for the delivery of an iRNA will include regulatory elements (promoter, enhancer, etc.) sufficient for expression of the iRNA in the desired target cell or tissue. The regulatory elements can be chosen to provide either constitutive or regulated/inducible expression.

Expression of the iRNA can be precisely regulated, for example, by using an inducible regulatory sequence that is sensitive to certain physiological regulators, e.g., circulating glucose levels, or hormones (Docherty et al., 1994, *FASEB J.* 8:20-24). Such inducible expression systems, suitable for the control of dsRNA expression in cells or in mammals include, for example, regulation by ecdysone, by estrogen, progesterone, tetracycline, chemical inducers of dimerization, and isopropyl-β-D1-thiogalactopyranoside (IPTG). A person skilled in the art would be able to choose the appropriate regulatory/promoter sequence based on the intended use of the iRNA transgene.

In a specific embodiment, viral vectors that contain nucleic acid sequences encoding an iRNA can be used. For example, a retroviral vector can be used (see Miller et al., *Meth. Enzymol.* 217:581-599 (1993)). These retroviral vectors contain the components necessary for the correct packaging of the viral genome and integration into the host cell DNA. The nucleic acid sequences encoding an iRNA are cloned into one or more vectors, which facilitates delivery of the nucleic acid into a patient. More detail about retroviral vectors can be found, for example, in Boesen et al., *Biotherapy* 6:291-302 (1994), which describes the use of a retroviral vector to deliver the mdr1 gene to hematopoietic stem cells in order to make the stem cells more resistant to chemotherapy. Other references illustrating the use of retroviral vectors in gene therapy are: Clowes et al., *J. Clin. Invest.* 93:644-651 (1994); Kiem et al., *Blood* 83:1467-1473 (1994); Salmons and Gunzberg, *Human Gene Therapy* 4:129-141 (1993); and Grossman and Wilson, *Curr. Opin. in Genetics and Devel.* 3:110-114 (1993). Lentiviral vectors contemplated for use include, for example, the HIV based vectors described in U.S. Pat. Nos. 6,143,520; 5,665,557; and 5,981,276, which are herein incorporated by reference.

Adenoviruses are also contemplated for use in delivery of iRNAs. Adenoviruses are especially attractive vehicles, e.g., for delivering genes to respiratory epithelia. Adenoviruses naturally infect respiratory epithelia where they cause a mild disease. Other targets for adenovirus-based delivery systems are liver, the central nervous system, endothelial cells, and muscle. Adenoviruses have the advantage of being capable of infecting non-dividing cells. Kozarsky and Wilson, *Current Opinion in Genetics and Development* 3:499-503 (1993) present a review of adenovirus-based gene therapy. Bout et al., *Human Gene Therapy* 5:3-10 (1994) demonstrated the use of adenovirus vectors to transfer genes to the respiratory epithelia of rhesus monkeys. Other instances of the use of adenoviruses in gene therapy can be found in Rosenfeld et al., *Science* 252:431-434 (1991); Rosenfeld et al., *Cell* 68:143-155 (1992); Mastrangeli et al., *J. Clin. Invest.* 91:225-234 (1993); PCT Publication WO94/12649; and Wang, et al., *Gene Therapy* 2:775-783 (1995). A suitable AV vector for expressing an iRNA featured in the disclosure, a method for constructing the recombinant AV vector, and a method for delivering the vector into target cells, are described in Xia H et al. (2002), *Nat. Biotech.* 20: 1006-1010.

Use of Adeno-associated virus (AAV) vectors is also contemplated (Walsh et al., *Proc. Soc. Exp. Biol. Med.* 204:289-300 (1993); U.S. Pat. No. 5,436,146). In some embodiments, the iRNA can be expressed as two separate, complementary single-stranded RNA molecules from a recombinant AAV vector having, for example, either the U6 or H1 RNA promoters, or the cytomegalovirus (CMV) promoter. Suitable AAV vectors for expressing the dsRNA featured in the disclosure, methods for constructing the recombinant AV vector, and methods for delivering the vectors into target cells are described in Samulski R et al. (1987), *J. Virol.* 61: 3096-3101; Fisher K J et al. (1996), *J. Virol.,* 70: 520-532; Samulski R et al. (1989), *J. Virol.* 63: 3822-3826; U.S. Pat. Nos. 5,252,479; 5,139,941; International Patent Application No. WO 94/13788; and International Patent Application No. WO 93/24641, the entire disclosures of which are herein incorporated by reference.

Another typical viral vector is a pox virus such as a vaccinia virus, for example an attenuated vaccinia such as Modified Virus Ankara (MVA) or NYVAC, an avipox such as fowl pox or canary pox.

The tropism of viral vectors can be modified by pseudotyping the vectors with envelope proteins or other surface antigens from other viruses, or by substituting different viral capsid proteins, as appropriate. For example, lentiviral vectors can be pseudotyped with surface proteins from vesicular stomatitis virus (VSV), rabies, Ebola, Mokola, and the like. AAV vectors can be made to target different cells by engineering the vectors to express different capsid protein serotypes; see, e.g., Rabinowitz J E et al. (2002), *J Virol* 76:791-801, the entire disclosure of which is herein incorporated by reference.

The pharmaceutical preparation of a vector can include the vector in an acceptable diluent, or can include a slow release matrix in which the gene delivery vehicle is imbedded. Alternatively, where the complete gene delivery vector can be produced intact from recombinant cells, e.g., retroviral vectors, the pharmaceutical preparation can include one or more cells which produce the gene delivery system.

III. Pharmaceutical Compositions Containing iRNA

In some embodiments, the disclosure provides pharmaceutical compositions containing an iRNA, as described herein, and a pharmaceutically acceptable carrier. The pharmaceutical composition containing the iRNA is useful for treating a disease or disorder related to the expression or activity of SCN9A (e.g., pain, e.g., chronic pain or pain-related disorder). Such pharmaceutical compositions are formulated based on the mode of delivery. In some embodiments, compositions can be formulated for localized delivery, e.g., by CNS delivery (e.g., intrathecal, intracranial, intracerebral, intraventricular, epidural, or intraganglionic routes of injection, optionally by infusion into the brain or spine, e.g., by continuous pump infusion). In another example, compositions can be formulated for systemic administration via parenteral delivery, e.g., by intravenous (IV) delivery, intramuscular (IM), or subcutaneous delivery (subQ). In some embodiments, a composition provided herein (e.g., a composition comprising a GalNAc conjugate or an LNP formulation) is formulated for intravenous delivery.

The pharmaceutical compositions featured herein are administered in a dosage sufficient to inhibit expression of SCN9A. In general, a suitable dose of iRNA will be in the range of 0.01 to 200.0 milligrams per kilogram body weight of the recipient per day, generally in the range of 1 to 50 mg per kilogram body weight per day. For example, the dsRNA can be administered at 0.05 mg/kg, 0.5 mg/kg, 1 mg/kg, 1.5 mg/kg, 2 mg/kg, 3 mg/kg, 10 mg/kg, 20 mg/kg, 30 mg/kg, 40 mg/kg, or 50 mg/kg per single dose.

In some embodiments, a repeat-dose regimen may include administration of a therapeutic amount of a RNAi agent on a regular basis, such as monthly to once every six months. In certain embodiments, the RNAi agent is administered about once per quarter (i.e., about once every three months) to about twice per year.

After an initial treatment regimen (e.g., loading dose), the treatments can be administered on a less frequent basis.

In other embodiments, the pharmaceutical composition may be administered once daily, or the iRNA may be administered as two, three, or more sub-doses at appropriate intervals throughout the day or even using continuous infusion or delivery through a controlled release formulation. In that case, the iRNA contained in each sub-dose must be correspondingly smaller in order to achieve the total daily dosage. The dosage unit can also be compounded for delivery over several days, e.g., using a conventional sustained release formulation which provides sustained release of the iRNA over a several day period. Sustained release formulations are well known in the art and are particularly useful for delivery of agents at a particular site, such as can be used with the agents of the present disclosure. In this embodiment, the dosage unit contains a corresponding multiple of the daily dose.

The effect of a single dose on SCN9A levels can be long lasting, such that subsequent doses are administered at not more than 3, 4, or 5-day intervals, or at not more than 1, 2, 3, 4, 12, 24, or 36-week intervals.

The skilled artisan will appreciate that certain factors may influence the dosage and timing required to effectively treat a subject, including but not limited to the severity of the disease or disorder, previous treatments, the general health and/or age of the subject, and other diseases present. Moreover, treatment of a subject with a therapeutically effective amount of a composition can include a single treatment or a series of treatments. Estimates of effective dosages and in vivo half-lives for the individual iRNAs encompassed by the disclosure can be made using conventional methodologies or on the basis of in vivo testing using a suitable animal model.

A suitable animal model, e.g., a mouse or a cynomolgus monkey, e.g., an animal containing a transgene expressing human SCN9A, can be used to determine the therapeutically effective dose and/or an effective dosage regimen administration of SCN9A siRNA.

In some embodiments, the iRNA compounds described herein can be delivered in a manner to target a particular tissue, such as the CNS (e.g., optionally the brain or spine tissue, e.g., cortex, cerebellum, dorsal root ganglia, substantia nigra, cerebellar dentate nucleus, pallidum, striatum, brainstem, thalamus, subthalamic, red, and pontine nuclei, cranial nerve nuclei and the anterior horn; and Clarke's column of the spinal cord cervical spine, lumbar spine, or thoracic spine).

The present disclosure also includes pharmaceutical compositions and formulations that include the iRNA compounds featured herein. The pharmaceutical compositions of the present disclosure may be administered in a number of ways depending upon whether local or systemic treatment is desired and upon the area to be treated. Administration may be local (e.g., by intrathecal, intraventricular, intracranial, epidural, or intraganglionic injection), topical (e.g., buccal and sublingual administration), oral, intravitreal, transdermal, airway (aerosol), nasal, rectal, or parenteral. Parenteral administration includes intravenous, intraarterial, subcutaneous, intraperitoneal or intramuscular injection or infusion; subdermal, e.g., via an implanted device; or intracranial, e.g., by intraparenchymal, intrathecal, or intraventricular administration.

In some embodiments, the administration is via a bolus injection. In some embodiments, the administration is via a depot injection. A depot injection may release the RNAi agent in a consistent way over a prolonged time period. Thus, a depot injection may reduce the frequency of dosing needed to obtain a desired effect, e.g., a desired inhibition of SCN9A, or a therapeutic or prophylactic effect.

In some embodiments, the administration is via a pump. The pump may be an external pump or a surgically implanted pump. In other embodiments, the pump is an infusion pump. An infusion pump may be used for intracranial, intravenous, or epidural infusions. In certain embodiments, the pump is a surgically implanted pump that delivers the RNAi agent to the CNS.

Pharmaceutical compositions and formulations for topical administration may include transdermal patches, ointments, lotions, creams, gels, drops, suppositories, sprays, liquids and powders. Conventional pharmaceutical carriers, aqueous, powder or oily bases, thickeners and the like may be necessary or desirable. Coated condoms, gloves and the like may also be useful. Suitable topical formulations include those in which the iRNAs featured in the disclosure are in admixture with a topical delivery agent such as lipids, liposomes, fatty acids, fatty acid esters, steroids, chelating agents and surfactants. Suitable lipids and liposomes include neutral (e.g., dioleoylphosphatidyl DOPE ethanolamine, dimyristoylphosphatidyl choline DMPC, distearolyphosphatidyl choline) negative (e.g., dimyristoylphosphatidyl glycerol DMPG) and cationic (e.g., dioleoyltetramethylaminopropyl DOTAP and dioleoylphosphatidyl ethanolamine DOTMA). iRNAs featured in the disclosure may be encapsulated within liposomes or may form complexes thereto, in particular to cationic liposomes. Alternatively, iRNAs may be complexed to lipids, in particular to cationic lipids. Suitable fatty acids and esters include but are not limited to arachidonic acid, oleic acid, eicosanoic acid, lauric acid, caprylic acid, capric acid, myristic acid, palmitic acid, stearic acid, linoleic acid, linolenic acid, dicaprate, tricaprate, monoolein, dilaurin, glyceryl 1-monocaprate, 1-dodecylazacycloheptan-2-one, an acylcarnitine, an acylcholine, or a $C_{1-20}$ alkyl ester (e.g., isopropylmyristate IPM), monoglyceride, diglyceride or pharmaceutically acceptable salt thereof. Topical formulations are described in detail in U.S. Pat. No. 6,747,014, which is incorporated herein by reference.

Liposomal Formulations

There are many organized surfactant structures besides microemulsions that have been studied and used for the formulation of drugs. These include monolayers, micelles, bilayers and vesicles. Vesicles, such as liposomes, have attracted great interest because of their specificity and the duration of action they offer from the standpoint of drug delivery. As used in the present disclosure, the term "liposome" means a vesicle composed of amphiphilic lipids arranged in a spherical bilayer or bilayers.

Liposomes are unilamellar or multilamellar vesicles which have a membrane formed from a lipophilic material and an aqueous interior. The aqueous portion contains the composition to be delivered. Cationic liposomes possess the advantage of being able to fuse to the cell wall. Non-cationic liposomes, although not able to fuse as efficiently with the cell wall, are taken up by macrophages in vivo.

In order to traverse intact mammalian skin, lipid vesicles must pass through a series of fine pores, each with a diameter less than 50 nm, under the influence of a suitable transdermal gradient. Therefore, it is desirable to use a liposome which is highly deformable and able to pass through such fine pores.

Further advantages of liposomes include; liposomes obtained from natural phospholipids are biocompatible and biodegradable; liposomes can incorporate a wide range of water and lipid soluble drugs; liposomes can protect encapsulated drugs in their internal compartments from metabolism and degradation (Rosoff, in *Pharmaceutical Dosage Forms*, Lieberman, Rieger and Banker (Eds.), 1988, Marcel Dekker, Inc., New York, N.Y., volume 1, p. 245). Important considerations in the preparation of liposome formulations are the lipid surface charge, vesicle size and the aqueous volume of the liposomes.

Liposomes are useful for the transfer and delivery of active ingredients to the site of action. Because the liposomal membrane is structurally similar to biological membranes, when liposomes are applied to a tissue, the liposomes start to merge with the cellular membranes and as the merging of the liposome and cell progresses, the liposomal contents are emptied into the cell where the active agent may act.

Liposomal formulations have been the focus of extensive investigation as the mode of delivery for many drugs. There is growing evidence that for topical administration, liposomes present several advantages over other formulations. Such advantages include reduced side-effects related to high systemic absorption of the administered drug, increased accumulation of the administered drug at the desired target, and the ability to administer a wide variety of drugs, both hydrophilic and hydrophobic, into the skin.

Several reports have detailed the ability of liposomes to deliver agents including high-molecular weight DNA into the skin. Compounds including analgesics, antibodies, hormones and high-molecular weight DNAs have been administered to the skin. The majority of applications resulted in the targeting of the upper epidermis Liposomes fall into two broad classes. Cationic liposomes are positively charged liposomes which interact with the negatively charged DNA molecules to form a stable complex. The positively charged DNA/liposome complex binds to the negatively charged cell surface and is internalized in an endosome. Due to the acidic pH within the endosome, the liposomes are ruptured, releasing their contents into the cell cytoplasm (Wang et al., *Biochem. Biophys. Res. Commun.*, 1987, 147, 980-985).

Liposomes which are pH-sensitive or negatively charged, entrap DNA rather than complex with it. Since both the DNA and the lipid are similarly charged, repulsion rather than complex formation occurs. Nevertheless, some DNA is entrapped within the aqueous interior of these liposomes. pH-sensitive liposomes have been used to deliver DNA encoding the thymidine kinase gene to cell monolayers in culture. Expression of the exogenous gene was detected in the target cells (Zhou et al., *Journal of Controlled Release*, 1992, 19, 269-274).

One major type of liposomal composition includes phospholipids other than naturally derived phosphatidylcholine. Neutral liposome compositions, for example, can be formed from dimyristoyl phosphatidylcholine (DMPC) or dipalmitoyl phosphatidylcholine (DPPC). Anionic liposome compositions generally are formed from dimyristoyl phosphatidylglycerol, while anionic fusogenic liposomes are formed primarily from dioleoyl phosphatidylethanolamine (DOPE). Another type of liposomal composition is formed from phosphatidylcholine (PC) such as, for example, soybean PC, and egg PC. Another type is formed from mixtures of phospholipid and/or phosphatidylcholine and/or cholesterol.

Several studies have assessed the topical delivery of liposomal drug formulations to the skin. Application of liposomes containing interferon to guinea pig skin resulted in a reduction of skin herpes sores while delivery of interferon via other means (e.g., as a solution or as an emulsion) were ineffective (Weiner et al., *Journal of Drug Targeting*, 1992, 2, 405-410). Further, an additional study tested the efficacy of interferon administered as part of a liposomal formulation to the administration of interferon using an aqueous system, and concluded that the liposomal formulation was superior to aqueous administration (du Plessis et al., *Antiviral Research*, 1992, 18, 259-265).

Non-ionic liposomal systems have also been examined to determine their utility in the delivery of drugs to the skin, in particular systems comprising non-ionic surfactant and cholesterol. Non-ionic liposomal formulations comprising Novasome™ I (glyceryl dilaurate/cholesterol/polyoxyethylene-10-stearyl ether) and Novasome™ II (glyceryl distearate/cholesterol/polyoxyethylene-10-stearyl ether) were used to deliver cyclosporin-A into the dermis of mouse skin. Results indicated that such non-ionic liposomal systems were effective in facilitating the deposition of cyclosporin-A into different layers of the skin (Hu et al. S.T.P. *Pharma. Sci.*, 1994, 4, 6, 466).

Liposomes also include "sterically stabilized" liposomes, a term which, as used herein, refers to liposomes comprising one or more specialized lipids that, when incorporated into liposomes, result in enhanced circulation lifetimes relative to liposomes lacking such specialized lipids. Examples of sterically stabilized liposomes are those in which part of the vesicle-forming lipid portion of the liposome (A) comprises one or more glycolipids, such as monosialoganglioside $G_{M1}$, or (B) is derivatized with one or more hydrophilic polymers, such as a polyethylene glycol (PEG) moiety. While not wishing to be bound by any particular theory, it is thought in the art that, at least for sterically stabilized liposomes containing gangliosides, sphingomyelin, or PEG-derivatized lipids, the enhanced circulation half-life of these sterically stabilized liposomes derives from a reduced uptake into cells of the reticuloendothelial system (RES) (Allen et al., *FEBS Letters*, 1987, 223, 42; Wu et al., *Cancer Research*, 1993, 53, 3765).

Various liposomes comprising one or more glycolipids are known in the art. Papahadjopoulos et al. (*Ann. N.Y. Acad. Sci.*, 1987, 507, 64) reported the ability of monosialoganglioside $G_{M1}$, galactocerebroside sulfate and phosphatidylinositol to improve blood half-lives of liposomes. These findings were expounded upon by Gabizon et al. (*Proc. Natl. Acad. Sci. U.S.A.*, 1988, 85, 6949). U.S. Pat. No. 4,837,028 and WO 88/04924, both to Allen et al., disclose liposomes comprising (1) sphingomyelin and (2) the ganglioside $G_{M1}$ or a galactocerebroside sulfate ester. U.S. Pat. No. 5,543,152 (Webb et al.) discloses liposomes comprising sphingomyelin. Liposomes comprising 1,2-sn-dimyristoylphosphatidylcholine are disclosed in WO 97/13499 (Lim et al).

Many liposomes comprising lipids derivatized with one or more hydrophilic polymers, and methods of preparation thereof, are known in the art. Sunamoto et al. (*Bull. Chem. Soc. Jpn.*, 1980, 53, 2778) described liposomes comprising a nonionic detergent, $2C_{1215G}$, that contains a PEG moiety. Ilium et al. (*FEBS Lett.*, 1984, 167, 79) noted that hydrophilic coating of polystyrene particles with polymeric glycols results in significantly enhanced blood half-lives. Synthetic phospholipids modified by the attachment of carboxylic groups of polyalkylene glycols (e.g., PEG) are described by Sears (U.S. Pat. Nos. 4,426,330 and 4,534, 899). Klibanov et al. (*FEBS Lett.*, 1990, 268, 235) described experiments demonstrating that liposomes comprising phosphatidylethanolamine (PE) derivatized with PEG or PEG stearate have significant increases in blood circulation half-lives. Blume et al. (*Biochimica et Biophysica Acta*, 1990, 1029, 91) extended such observations to other PEG-derivatized phospholipids, e.g., DSPE-PEG, formed from the combination of distearoylphosphatidylethanolamine (DSPE) and PEG. Liposomes having covalently bound PEG moieties on their external surface are described in European Patent No. EP 0 445 131 B1 and WO 90/04384 to Fisher. Liposome compositions containing 1-20 mole percent of PE derivatized with PEG, and methods of use thereof, are described by Woodle et al. (U.S. Pat. Nos. 5,013,556 and 5,356,633) and Martin et al. (U.S. Pat. No. 5,213,804 and European Patent No. EP 0 496 813 B1). Liposomes comprising a number of other lipid-polymer conjugates are disclosed in WO 91/05545 and U.S. Pat. No. 5,225,212 (both to Martin et al.) and in WO 94/20073 (Zalipsky et al.). Liposomes comprising PEG-modified ceramide lipids are described in WO 96/10391 (Choi et al). U.S. Pat. No. 5,540,935 (Miyazaki et al.) and U.S. Pat. No. 5,556,948 (Tagawa et al.) describe PEG-containing liposomes that can be further derivatized with functional moieties on their surfaces.

A number of liposomes comprising nucleic acids are known in the art. WO 96/40062 to Thierry et al. discloses methods for encapsulating high molecular weight nucleic acids in liposomes. U.S. Pat. No. 5,264,221 to Tagawa et al. discloses protein-bonded liposomes and asserts that the contents of such liposomes may include a dsRNA. U.S. Pat. No. 5,665,710 to Rahman et al. describes certain methods of encapsulating oligodeoxynucleotides in liposomes. WO 97/04787 to Love et al. discloses liposomes comprising dsRNAs targeted to the raf gene.

Transfersomes are yet another type of liposomes, and are highly deformable lipid aggregates which are attractive candidates for drug delivery vehicles. Transfersomes may be described as lipid droplets which are so highly deformable that they are easily able to penetrate through pores which are smaller than the droplet. Transfersomes are adaptable to the environment in which they are used, e.g., they are self-optimizing (adaptive to the shape of pores in the skin), self-repairing, frequently reach their targets without fragmenting, and often self-loading. To make transfersomes it is possible to add surface edge-activators, usually surfactants, to a standard liposomal composition. Transfersomes have been used to deliver serum albumin to the skin. The transfersome-mediated delivery of serum albumin has been shown to be as effective as subcutaneous injection of a solution containing serum albumin.

Surfactants find wide application in formulations such as emulsions (including microemulsions) and liposomes. The most common way of classifying and ranking the properties of the many different types of surfactants, both natural and synthetic, is by the use of the hydrophile/lipophile balance (HLB). The nature of the hydrophilic group (also known as the "head") provides the most useful means for categorizing the different surfactants used in formulations (Rieger, in *Pharmaceutical Dosage Forms*, Marcel Dekker, Inc., New York, N.Y., 1988, p. 285).

If the surfactant molecule is not ionized, it is classified as a nonionic surfactant. Nonionic surfactants find wide application in pharmaceutical and cosmetic products and are usable over a wide range of pH values. In general, their HLB values range from 2 to about 18 depending on their structure. Nonionic surfactants include nonionic esters such as ethylene glycol esters, propylene glycol esters, glyceryl esters, polyglyceryl esters, sorbitan esters, sucrose esters, and ethoxylated esters. Nonionic alkanolamides and ethers such as fatty alcohol ethoxylates, propoxylated alcohols, and ethoxylated/propoxylated block polymers are also included in this class. The polyoxyethylene surfactants are the most popular members of the nonionic surfactant class.

If the surfactant molecule carries a negative charge when it is dissolved or dispersed in water, the surfactant is classified as anionic. Anionic surfactants include carboxylates such as soaps, acyl lactylates, acyl amides of amino acids, esters of sulfuric acid such as alkyl sulfates and ethoxylated alkyl sulfates, sulfonates such as alkyl benzene sulfonates, acyl isethionates, acyl taurates and sulfosuccinates, and phosphates. The most important members of the anionic surfactant class are the alkyl sulfates and the soaps.

If the surfactant molecule carries a positive charge when it is dissolved or dispersed in water, the surfactant is classified as cationic. Cationic surfactants include quaternary ammonium salts and ethoxylated amines. The quaternary ammonium salts are the most used members of this class.

If the surfactant molecule has the ability to carry either a positive or negative charge, the surfactant is classified as amphoteric Amphoteric surfactants include acrylic acid derivatives, substituted alkylamides, N-alkylbetaines and phosphatides.

The use of surfactants in drug products, formulations and in emulsions has been reviewed (Rieger, in *Pharmaceutical Dosage Forms*, Marcel Dekker, Inc., New York, N.Y., 1988, p. 285).

Nucleic Acid Lipid Particles

In some embodiments, an SCN9A dsRNA featured in the disclosure is fully encapsulated in the lipid formulation, e.g., to form a SPLP, pSPLP, SNALP, or other nucleic acid-lipid particle. SNALPs and SPLPs typically contain a cationic lipid, a non-cationic lipid, and a lipid that prevents aggregation of the particle (e.g., a PEG-lipid conjugate). SNALPs and SPLPs are extremely useful for systemic applications, as they exhibit extended circulation lifetimes following intravenous (i.v.) injection and accumulate at distal sites (e.g., sites physically separated from the administration site). SPLPs include "pSPLP," which include an encapsulated condensing agent-nucleic acid complex as set forth in PCT Publication No. WO 00/03683. The particles of the present disclosure typically have a mean diameter of about 50 nm to about 150 nm, more typically about 60 nm to about 130 nm, more typically about 70 nm to about 110 nm, most typically about 70 nm to about 90 nm, and are substantially nontoxic. In addition, the nucleic acids when present in the nucleic acid-lipid particles of the present disclosure are resistant in aqueous solution to degradation with a nuclease. Nucleic acid-lipid particles and their method of preparation are disclosed in, e.g., U.S. Pat. Nos. 5,976,567; 5,981,501; 6,534,484; 6,586,410; 6,815,432; and PCT Publication No. WO 96/40964.

In some embodiments, the lipid to drug ratio (mass/mass ratio) (e.g., lipid to dsRNA ratio) will be in the range of from about 1:1 to about 50:1, from about 1:1 to about 25:1, from about 3:1 to about 15:1, from about 4:1 to about 10:1, from about 5:1 to about 9:1, or about 6:1 to about 9:1.

The cationic lipid may be, for example, N,N-dioleyl-N, N-dimethylammonium chloride (DODAC), N,N-distearyl-N,N-dimethylammonium bromide (DDAB), N-(I-(2,3-dioleoyloxy)propyl)-N,N,N-trimethylammonium chloride (DOTAP), N-(I-(2,3-dioleyloxy)propyl)-N,N,N-trimethylammonium chloride (DOTMA), N,N-dimethyl-2,3-dioleyloxy)propylamine (DODMA), 1,2-DiLinoleyloxy-N,N-dimethylaminopropane (DLinDMA), 1,2-Dilinolenyloxy-N,N-dimethylaminopropane (DLenDMA), 1,2-Dilinoleylcarbamoyloxy-3-dimethylaminopropane (DLin-C-DAP), 1,2-Dilinoleyoxy-3-(dimethylamino) acetoxypropane (DLin-DAC), 1,2-Dilinoleyoxy-3-morpholinopropane (DLin-MA), 1,2-Dilinoleoyl-3-dimethylaminopropane (DLinDAP), 1,2-Dilinoleylthio-3-dimethylaminopropane (DLin-S-DMA), 1-Linoleoyl-2-linoleyloxy-3-dimethylaminopropane (DLin-2-DMAP), 1,2-Dilinoleyloxy-3-trimethylaminopropane chloride salt (DLin-TMA.Cl), 1,2-Dilinoleoyl-3-trimethylaminopropane chloride salt (DLin-TAP.Cl), 1,2-Dilinoleyloxy-3-(N-methylpiperazino)propane (DLin-MPZ), or 3-(N,N-Dilinoleylamino)-1,2-propanediol (DLinAP), 3-(N,N-Dioleylamino)-1,2-propanedio (DOAP), 1,2-Dilinoleyloxo-3-(2-N,N-dimethylamino)ethoxypropane (DLin-EG-DMA), 1,2-Dilinolenyloxy-N,N-dimethylaminopropane (DLinDMA), 2,2-Dilinoleyl-4-dimethylaminomethyl-[1,3]-dioxolane (DLin-K-DMA) or analogs thereof, (3aR,5s,6aS)—N,N-dimethyl-2,2-di((9Z,12Z)-octadeca-9,12-dienyl)tetrahydro-3aH-cyclopenta[d][1,3]dioxol-5-amine (ALN100), (6Z,9Z, 28Z,31Z)-heptatriaconta-6,9,28,31-tetraen-19-yl 4-(dimethylamino)butanoate (MC3), 1,1'-(2-(4-(2-((2-(bis (2-hydroxydodecyl)amino)ethyl)(2-hydroxydodecyl)amino) ethyl)piperazin-1-yl)ethylazanediyl)didodecan-2-ol (Tech G1), or a mixture thereof. The cationic lipid may comprise from about 20 mol % to about 50 mol % or about 40 mol % of the total lipid present in the particle.

In some embodiments, the compound 2,2-Dilinoleyl-4-dimethylaminoethyl[1,3]-dioxolane can be used to prepare lipid-siRNA nanoparticles. Synthesis of 2,2-Dilinoleyl-4-dimethylaminoethyl-[1,3]-dioxolane is described in U.S. provisional patent application No. 61/107,998 filed on Oct. 23, 2008, which is herein incorporated by reference.

In some embodiments, the lipid-siRNA particle includes 40% 2, 2-Dilinoleyl-4-dimethylaminoethyl-[1,3]-dioxolane: 10% DSPC: 40% Cholesterol: 10% PEG-C-DOMG (mole percent) with a particle size of 63.0±20 nm and a 0.027 siRNA/Lipid Ratio.

The non-cationic lipid may be an anionic lipid or a neutral lipid including, but not limited to, distearoylphosphatidylcholine (DSPC), dioleoylphosphatidylcholine (DOPC), dipalmitoylphosphatidylcholine (DPPC), dioleoylphosphatidylglycerol (DOPG), dipalmitoylphosphatidylglycerol (DPPG), dioleoyl-phosphatidylethanolamine (DOPE), palmitoyloleoylphosphatidylcholine (POPC), palmitoyloleoylphosphatidylethanolamine (POPE), dioleoyl-phosphatidylethanolamine 4-(N-maleimidomethyl)-cyclohexane-1-carboxylate (DOPE-mal), dipalmitoyl phosphatidyl ethanolamine (DPPE), dimyristoylphosphoethanolamine (DMPE), distearoyl-phosphatidyl-ethanolamine (DSPE), 16-O-monomethyl PE, 16-O-dimethyl PE, 18-1-trans PE, 1-stearoyl-2-oleoyl-phosphatidyethanolamine (SOPE), cholesterol, or a mixture thereof. The non-cationic lipid may be from about 5 mol % to about 90 mol %, about 10 mol %, or about 58 mol % if cholesterol is included, of the total lipid present in the particle.

The conjugated lipid that inhibits aggregation of particles may be, for example, a polyethyleneglycol (PEG)-lipid including, without limitation, a PEG-diacylglycerol (DAG), a PEG-dialkyloxypropyl (DAA), a PEG-phospholipid, a PEG-ceramide (Cer), or a mixture thereof. The PEG-DAA conjugate may be, for example, a PEG-dilauryloxypropyl ($Ci_2$), a PEG-dimyristyloxypropyl ($Ci_4$), a PEG-dipalmityloxypropyl ($Ci_6$), or a PEG-distearyloxypropyl ($C]_8$). The conjugated lipid that prevents aggregation of particles may be from 0 mol % to about 20 mol % or about 2 mol % of the total lipid present in the particle.

In some embodiments, the nucleic acid-lipid particle further includes cholesterol at, e.g., about 10 mol % to about 60 mol % or about 48 mol % of the total lipid present in the particle.

In some embodiments, the iRNA is formulated in a lipid nanoparticle (LNP).

LNP01

In some embodiments, the lipidoid ND98.4HCl (MW 1487) (see U.S. patent application Ser. No. 12/056,230, filed Mar. 26, 2008, which is herein incorporated by reference), Cholesterol (Sigma-Aldrich), and PEG-Ceramide C16 (Avanti Polar Lipids) can be used to prepare lipid-dsRNA nanoparticles (e.g., LNP01 particles). Stock solutions of each in ethanol can be prepared as follows: ND98, 133 mg/ml; Cholesterol, 25 mg/ml, PEG-Ceramide C16, 100 mg/ml. The ND98, Cholesterol, and PEG-Ceramide C16 stock solutions can then be combined in a, e.g., 42:48:10 molar ratio. The combined lipid solution can be mixed with aqueous dsRNA (e.g., in sodium acetate pH 5) such that the final ethanol concentration is about 35-45% and the final sodium acetate concentration is about 100-300 mM. Lipid-dsRNA nanoparticles typically form spontaneously upon mixing. Depending on the desired particle size distribution, the resultant nanoparticle mixture can be extruded through a polycarbonate membrane (e.g., 100 nm cut-off) using, for example, a thermobarrel extruder, such as Lipex Extruder (Northern Lipids, Inc). In some cases, the extrusion step can be omitted. Ethanol removal and simultaneous buffer exchange can be accomplished by, for example, dialysis or tangential flow filtration. Buffer can be exchanged with, for example, phosphate buffered saline (PBS) at about pH 7, e.g., about pH 6.9, about pH 7.0, about pH 7.1, about pH 7.2, about pH 7.3, or about pH 7.4.

Formula 1

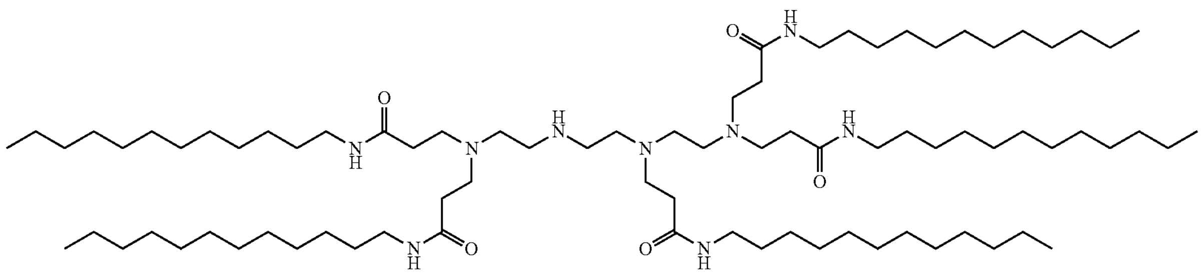

ND98 Isomer I

LNP01 formulations are described, e.g., in International Application Publication No. WO 2008/042973, which is hereby incorporated by reference.

Additional exemplary lipid-dsRNA formulations are provided in the following table.

TABLE 7

| Exemplary lipid formulations | | |
|---|---|---|
| | Cationic Lipid | cationic lipid/non-cationic lipid/ cholesterol/PEG-lipid conjugate Lipid:siRNA ratio |
| SNALP | 1,2-Dilinolenyloxy-N,N-dimethylaminopropane (DLinDMA) | DLinDMA/DPPC/Cholesterol/PEG-cDMA (57.1/7.1/34.4/1.4) lipid:siRNA ~7:1 |
| S-XTC | 2,2-Dilinoleyl-4-dimethylaminoethyl-[1,3]-dioxolane (XTC) | XTC/DPPC/Cholesterol/PEG-cDMA 57.1/7.1/34.4/1.4 lipid:siRNA ~7:1 |
| LNP05 | 2,2-Dilinoleyl-4-dimethylaminoethyl-[1,3]-dioxolane (XTC) | XTC/DSPC/Cholesterol/PEG-DMG 57.5/7.5/31.5/3.5 lipid:siRNA ~6:1 |
| LNP06 | 2,2-Dilinoleyl-4-dimethylaminoethyl-[1,3]-dioxolane (XTC) | XTC/DSPC/Cholesterol/PEG-DMG 57.5/7.5/31.5/3.5 lipid:siRNA ~11:1 |
| LNP07 | 2,2-Dilinoleyl-4-dimethylaminoethyl-[1,3]-dioxolane (XTC) | XTC/DSPC/Cholesterol/PEG-DMG 60/7.5/31/1.5, lipid:siRNA ~6:1 |
| LNP08 | 2,2-Dilinoleyl-4-dimethylaminoethyl-[1,3]-dioxolane (XTC) | XTC/DSPC/Cholesterol/PEG-DMG 60/7.5/31/1.5, lipid:siRNA ~11:1 |
| LNP09 | 2,2-Dilinoleyl-4-dimethylaminoethyl-[1,3]-dioxolane (XTC) | XTC/DSPC/Cholesterol/PEG-DMG 50/10/38.5/1.5 Lipid:siRNA 10:1 |
| LNP10 | (3aR,5s,6aS)-N,N-dimethyl-2,2-di((9Z,12Z)-octadeca-9,12-dienyl)tetrahydro-3aH-cyclopenta[d][1,3]dioxol-5-amine (ALN100) | ALN100/DSPC/Cholesterol/PEG-DMG 50/10/38.5/1.5 Lipid:siRNA 10:1 |
| LNP11 | (6Z,9Z,28Z,31Z)-heptatriaconta-6,9,28,31-tetraen-19-yl 4-(dimethylamino)butanoate (MC3) | MC-3/DSPC/Cholesterol/PEG-DMG 50/10/38.5/1.5 Lipid:siRNA 10:1 |
| LNP12 | 1,1'-(2-(4-(2-((2-(bis(2-hydroxydodecyl)amino)ethyl)(2-hydroxydodecyl)amino)ethyl)piperazin-1-yl)ethylazanediyl)didodecan-2-ol (C12-200) | C12-200/DSPC/Cholesterol/PEG-DMG 50/10/38.5/1.5 Lipid:siRNA 10:1 |
| LNP13 | XTC | XTC/DSPC/Chol/PEG-DMG 50/10/38.5/1.5 Lipid:siRNA: 33:1 |
| LNP14 | MC3 | MC3/DSPC/Chol/PEG-DMG 40/15/40/5 Lipid:siRNA: 11:1 |
| LNP15 | MC3 | MC3/DSPC/Chol/PEG-DSG/GalNAc-PEG-DSG 50/10/35/4.5/0.5 Lipid:siRNA: 11:1 |
| LNP16 | MC3 | MC3/DSPC/Chol/PEG-DMG 50/10/38.5/1.5 Lipid:siRNA: 7:1 |

TABLE 7-continued

Exemplary lipid formulations

| | Cationic Lipid | cationic lipid/non-cationic lipid/ cholesterol/PEG-lipid conjugate Lipid:siRNA ratio |
|---|---|---|
| LNP17 | MC3 | MC3/DSPC/Chol/PEG-DSG 50/10/38.5/1.5 Lipid:siRNA: 10:1 |
| LNP18 | MC3 | MC3/DSPC/Chol/PEG-DMG 50/10/38.5/1.5 Lipid:siRNA: 12:1 |
| LNP19 | MC3 | MC3/DSPC/Chol/PEG-DMG 50/10/35/5 Lipid:siRNA: 8:1 |
| LNP20 | MC3 | MC3/DSPC/Chol/PEG-DPG 50/10/38.5/1.5 Lipid:siRNA: 10:1 |
| LNP21 | C12-200 | C12-200/DSPC/Chol/PEG-DSG 50/10/38.5/1.5 Lipid:siRNA: 7:1 |
| LNP22 | XTC | XTC/DSPC/Chol/PEG-DSG 50/10/38.5/1.5 Lipid:siRNA: 10:1 |

DSPC: distearoylphosphatidylcholine

DPPC: dipalmitoylphosphatidylcholine

PEG-DMG: PEG-didimyristoyl glycerol (C14-PEG, or PEG-C14) (PEG with avg mol wt of 2000)

PEG-DSG: PEG-distyryl glycerol (C18-PEG, or PEG-C18) (PEG with avg mol wt of 2000)

PEG-cDMA: PEG-carbamoyl-1,2-dimyristyloxypropylamine (PEG with avg mol wt of 2000)

SNALP (1,2-Dilinolenyloxy-N,N-dimethylaminopropane (DLinDMA)) comprising formulations are described in International Publication No. WO2009/127060, filed Apr. 15, 2009, which is hereby incorporated by reference.

XTC comprising formulations are described, e.g., in U.S. Provisional Ser. No. 61/148,366, filed Jan. 29, 2009; U.S. Provisional Ser. No. 61/156,851, filed Mar. 2, 2009; U.S. Provisional Ser. No. 61/185,712, filed Jun. 10, 2009; U.S. Provisional Ser. No. 61/228,373, filed Jul. 24, 2009; U.S. Provisional Ser. No. 61/239,686, filed Sep. 3, 2009, and International Application No. PCT/US2010/022614, filed Jan. 29, 2010, which are hereby incorporated by reference.

MC3 comprising formulations are described, e.g., in U.S. Provisional Ser. No. 61/244,834, filed Sep. 22, 2009, U.S. Provisional Ser. No. 61/185,800, filed Jun. 10, 2009, and International Application No. PCT/US10/28224, filed Jun. 10, 2010, which are hereby incorporated by reference.

ALNY-100 comprising formulations are described, e.g., International patent application number PCT/US09/63933, filed on Nov. 10, 2009, which is hereby incorporated by reference.

C12-200 comprising formulations are described in U.S. Provisional Ser. No. 61/175,770, filed May 5, 2009 and International Application No. PCT/US10/33777, filed May 5, 2010, which are hereby incorporated by reference.

Synthesis of Cationic Lipids

Any of the compounds, e.g., cationic lipids and the like, used in the nucleic acid-lipid particles featured in the disclosure may be prepared by known organic synthesis techniques. All substituents are as defined below unless indicated otherwise.

"Alkyl" means a straight chain or branched, noncyclic or cyclic, saturated aliphatic hydrocarbon containing from 1 to 24 carbon atoms. Representative saturated straight chain alkyls include methyl, ethyl, n-propyl, n-butyl, n-pentyl, n-hexyl, and the like; while saturated branched alkyls include isopropyl, sec-butyl, isobutyl, tert-butyl, isopentyl, and the like. Representative saturated cyclic alkyls include cyclopropyl, cyclobutyl, cyclopentyl, cyclohexyl, and the like; while unsaturated cyclic alkyls include cyclopentenyl and cyclohexenyl, and the like.

"Alkenyl" means an alkyl, as defined above, containing at least one double bond between adjacent carbon atoms. Alkenyls include both cis and trans isomers. Representative straight chain and branched alkenyls include ethylenyl, propylenyl, 1-butenyl, 2-butenyl, isobutylenyl, 1-pentenyl, 2-pentenyl, 3-methyl-1-butenyl, 2-methyl-2-butenyl, 2,3-dimethyl-2-butenyl, and the like.

"Alkynyl" means any alkyl or alkenyl, as defined above, which additionally contains at least one triple bond between adjacent carbons. Representative straight chain and branched alkynyls include acetylenyl, propynyl, 1-butynyl, 2-butynyl, 1-pentynyl, 2-pentynyl, 3-methyl-1 butynyl, and the like.

"Acyl" means any alkyl, alkenyl, or alkynyl wherein the carbon at the point of attachment is substituted with an oxo group, as defined below. For example, —C(=O)alkyl, —C(=O)alkenyl, and —C(=O)alkynyl are acyl groups.

"Heterocycle" means a 5- to 7-membered monocyclic, or 7- to 10-membered bicyclic, heterocyclic ring which is either saturated, unsaturated, or aromatic, and which contains from 1 or 2 heteroatoms independently selected from nitrogen, oxygen and sulfur, and wherein the nitrogen and sulfur heteroatoms may be optionally oxidized, and the nitrogen heteroatom may be optionally quaternized, including bicyclic rings in which any of the above heterocycles are fused to a benzene ring. The heterocycle may be attached via any heteroatom or carbon atom. Heterocycles include heteroaryls as defined below. Heterocycles include morpholinyl, pyrrolidinonyl, pyrrolidinyl, piperidinyl, piperizynyl, hydantoinyl, valerolactamyl, oxiranyl, oxetanyl, tetrahydrofuranyl, tetrahydropyranyl, tetrahydropyridinyl, tetrahydroprimidinyl, tetrahydrothiophenyl, tetrahydrothiopyranyl, tetrahydropyrimidinyl, tetrahydrothiophenyl, tetrahydrothiopyranyl, and the like.

The terms "optionally substituted alkyl", "optionally substituted alkenyl", "optionally substituted alkynyl", "optionally substituted acyl", and "optionally substituted heterocycle" means that, when substituted, at least one hydrogen atom is replaced with a substituent. In the case of an oxo substituent (=O) two hydrogen atoms are replaced. In this regard, substituents include oxo, halogen, heterocycle, —CN, —$OR^x$, —$NR^xR^y$, —$NR^xC(=O)R^y$, —$NR^xSO_2R^y$, —$C(=O)R^x$, —$C(=O)OR^x$, —$C(=O)NR^xR^y$, —$SO_nR^x$ and —$SO_nNR^xR^y$, wherein n is 0, 1 or 2, $R^x$ and $R^y$ are the same or different and independently hydrogen, alkyl or heterocycle, and each of said alkyl and heterocycle substituents may be further substituted with one or more of oxo, halogen, —OH, —CN, alkyl, —OR$^x$, heterocycle, —NR$^x$R$^y$, —NR$^x$C(═O)R$^y$, —NR$^x$SO$_2$R$^y$, —C(═O)R$^x$, —C(═O)OR$^x$, —C(═O)NR$^x$R$^y$, —SO$_n$R$^x$ and —SO$_n$-NR$^x$R$^y$.

"Halogen" means fluoro, chloro, bromo and iodo.

In some embodiments, the methods featured in the disclosure may require the use of protecting groups. Protecting group methodology is well known to those skilled in the art (see, for example, Protective Groups in Organic Synthesis, Green, T. W. et al., Wiley-Interscience, New York City, 1999). Briefly, protecting groups within the context of this disclosure are any group that reduces or eliminates unwanted reactivity of a functional group. A protecting group can be added to a functional group to mask its reactivity during certain reactions and then removed to reveal the original functional group. In some embodiments an "alcohol protecting group" is used. An "alcohol protecting group" is any group which decreases or eliminates unwanted reactivity of an alcohol functional group. Protecting groups can be added and removed using techniques well known in the art.

Synthesis of Formula A

In some embodiments, nucleic acid-lipid particles featured in the disclosure are formulated using a cationic lipid of formula A:

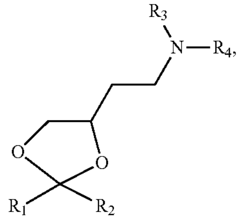

where R1 and R2 are independently alkyl, alkenyl or alkynyl, each can be optionally substituted, and R3 and R4 are independently lower alkyl or R3 and R4 can be taken together to form an optionally substituted heterocyclic ring. In some embodiments, the cationic lipid is XTC (2,2-Dilinoleyl-4-dimethylaminoethyl-[1,3]-dioxolane). In general, the lipid of formula A above may be made by the following Reaction Schemes 1 or 2, wherein all substituents are as defined above unless indicated otherwise.

Scheme 1

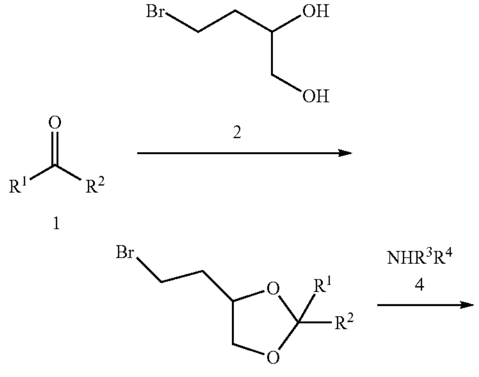

1

3

-continued

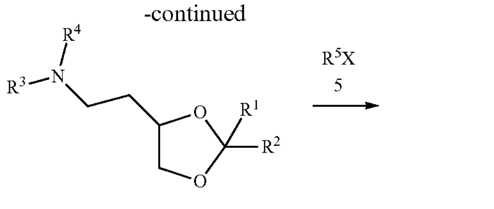

Formula A

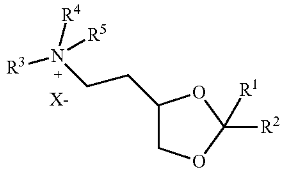

Lipid A, where $R_1$ and $R_2$ are independently alkyl, alkenyl or alkynyl, each can be optionally substituted, and $R_3$ and $R_4$ are independently lower alkyl or $R_3$ and $R_4$ can be taken together to form an optionally substituted heterocyclic ring, can be prepared according to Scheme 1. Ketone 1 and bromide 2 can be purchased or prepared according to methods known to those of ordinary skill in the art. Reaction of 1 and 2 yields ketal 3. Treatment of ketal 3 with amine 4 yields lipids of formula A. The lipids of formula A can be converted to the corresponding ammonium salt with an organic salt of formula 5, where X is anion counter ion selected from halogen, hydroxide, phosphate, sulfate, or the like.

Scheme 2

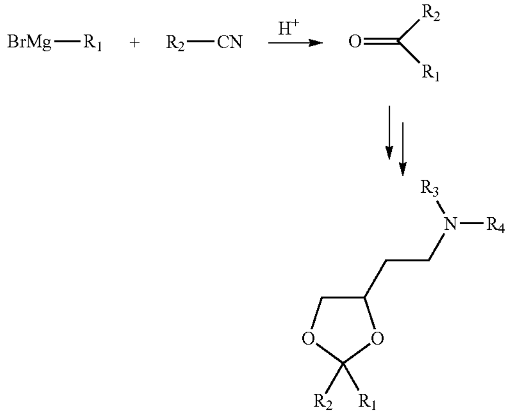

Alternatively, the ketone 1 starting material can be prepared according to Scheme 2. Grignard reagent 6 and cyanide 7 can be purchased or prepared according to methods known to those of ordinary skill in the art. Reaction of 6 and 7 yields ketone 1. Conversion of ketone 1 to the corresponding lipids of formula A is as described in Scheme 1.

Synthesis of MC3

Preparation of DLin-M-C3-DMA (i.e., (6Z,9Z,28Z,31Z)-heptatriaconta-6,9,28,31-tetraen-19-yl 4-(dimethylamino) butanoate) was as follows. A solution of (6Z,9Z,28Z,31Z)-heptatriaconta-6,9,28,31-tetraen-19-ol (0.53 g), 4-N,N-dimethylaminobutyric acid hydrochloride (0.51 g), 4-N,N-dimethylaminopyridine (0.61 g) and 1-ethyl-3-(3-dimethylaminopropyl)carbodiimide hydrochloride (0.53 g) in dichloromethane (5 mL) was stirred at room temperature overnight. The solution was washed with dilute hydrochloric acid followed by dilute aqueous sodium bicarbonate. The organic fractions were dried over anhydrous magnesium sulphate, filtered and the solvent removed on a rotovap. The residue was passed down a silica gel column (20 g) using a 1-5% methanol/dichloromethane elution gradient. Fractions containing the purified product were combined and the solvent removed, yielding a colorless oil (0.54 g).

Synthesis of ALNY-100

Synthesis of ketal 519 [ALNY-100] was performed using the following scheme 3:

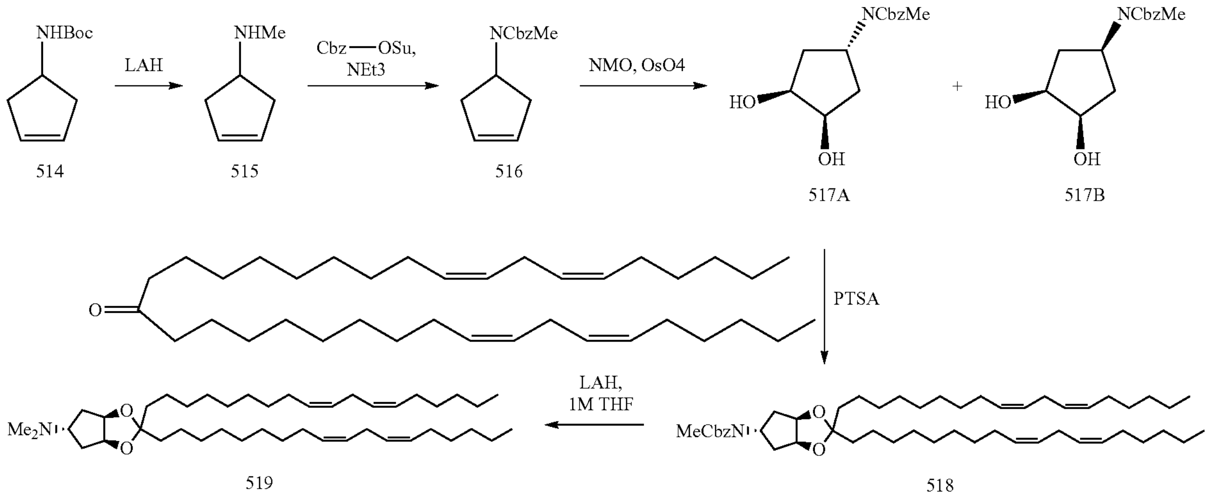

514 515 516 517A 517B 518 519

Synthesis of 515:

To a stirred suspension of LiAlH4 (3.74 g, 0.09852 mol) in 200 ml anhydrous THF in a two neck RBF (1 L), was added a solution of 514 (10 g, 0.04926 mol) in 70 mL of THF slowly at 0° C. under nitrogen atmosphere. After complete addition, reaction mixture was warmed to room temperature and then heated to reflux for 4 h. Progress of the reaction was monitored by TLC. After completion of reaction (by TLC) the mixture was cooled to 0° C. and quenched with careful addition of saturated Na2SO4 solution. Reaction mixture was stirred for 4 h at room temperature and filtered off. Residue was washed well with THF. The filtrate and washings were mixed and diluted with 400 mL dioxane and 26 mL conc. HCl and stirred for 20 minutes at room temperature. The volatilities were stripped off under vacuum to furnish the hydrochloride salt of 515 as a white solid. Yield: 7.12 g 1H-NMR (DMSO, 400 MHz): δ=9.34 (broad, 2H), 5.68 (s, 2H), 3.74 (m, 1H), 2.66-2.60 (m, 2H), 2.50-2.45 (m, 5H).

Synthesis of 516:

To a stirred solution of compound 515 in 100 mL dry DCM in a 250 mL two neck RBF, was added NEt3 (37.2 mL, 0.2669 mol) and cooled to 0° C. under nitrogen atmosphere. After a slow addition of N-(benzyloxy-carbonyloxy)-succinimide (20 g, 0.08007 mol) in 50 mL dry DCM, reaction mixture was allowed to warm to room temperature. After completion of the reaction (2-3 h by TLC) mixture was washed successively with 1N HCl solution (1×100 mL) and saturated $NaHCO_3$ solution (1×50 mL). The organic layer was then dried over anhyd. Na2SO4 and the solvent was evaporated to give crude material which was purified by silica gel column chromatography to get 516 as sticky mass. Yield: 11 g (89%). 1H-NMR (CDCl3, 400 MHz): δ=7.36-7.27 (m, 5H), 5.69 (s, 2H), 5.12 (s, 2H), 4.96 (br., 1H) 2.74 (s, 3H), 2.60 (m, 2H), 2.30-2.25 (m, 2H). LC-MS [M+H] −232.3 (96.94%).

Synthesis of 517A and 517B:

The cyclopentene 516 (5 g, 0.02164 mol) was dissolved in a solution of 220 mL acetone and water (10:1) in a single neck 500 mL RBF and to it was added N-methyl morpholine-N-oxide (7.6 g, 0.06492 mol) followed by 4.2 mL of 7.6% solution of OsO4 (0.275 g, 0.00108 mol) in tert-butanol at room temperature. After completion of the reaction (~3 h), the mixture was quenched with addition of solid Na2SO3 and resulting mixture was stirred for 1.5 h at room temperature. Reaction mixture was diluted with DCM (300 mL) and washed with water (2×100 mL) followed by saturated $NaHCO_3$(1×50 mL) solution, water (1×30 mL) and finally with brine (1×50 mL). Organic phase was dried over an.Na2SO4 and solvent was removed in vacuum. Silica gel column chromatographic purification of the crude material was afforded a mixture of diastereomers, which were separated by prep HPLC. Yield: −6 g crude 517A—Peak-1 (white solid), 5.13 g (96%). 1H-NMR (DMSO, 400 MHz): δ=7.39-7.31 (m, 5H), 5.04 (s, 2H), 4.78-4.73 (m, 1H), 4.48-4.47 (d, 2H), 3.94-3.93 (m, 2H), 2.71 (s, 3H), 1.72-1.67 (m, 4H). LC-MS-[M+H] −266.3, [M+NH4+] −283.5 present, HPLC-97.86%. Stereochemistry confirmed by X-ray.

Synthesis of 518:

Using a procedure analogous to that described for the synthesis of compound 505, compound 518 (1.2 g, 41%) was obtained as a colorless oil. 1H-NMR (CDCl3, 400 MHz): δ=7.35-7.33 (m, 4H), 7.30-7.27 (m, 1H), 5.37-5.27 (m, 8H), 5.12 (s, 2H), 4.75 (m, 1H), 4.58-4.57 (m, 2H), 2.78-2.74 (m, 7H), 2.06-2.00 (m, 8H), 1.96-1.91 (m, 2H), 1.62 (m, 4H), 1.48 (m, 2H), 1.37-1.25 (br m, 36H), 0.87 (m, 6H). HPLC-98.65%.

General Procedure for the Synthesis of Compound 519:

A solution of compound 518 (1 eq) in hexane (15 mL) was added in a drop-wise fashion to an ice-cold solution of LAH in THF (1 M, 2 eq). After complete addition, the mixture was heated at 40° C. over 0.5 h then cooled again on an ice bath. The mixture was carefully hydrolyzed with saturated aqueous Na2SO4 then filtered through celite and reduced to an oil. Column chromatography provided the pure 519 (1.3 g, 68%) which was obtained as a colorless oil. 13C NMR=130.2, 130.1 (×2), 127.9 (×3), 112.3, 79.3, 64.4, 44.7, 38.3, 35.4, 31.5, 29.9 (×2), 29.7, 29.6 (×2), 29.5 (×3), 29.3 (×2), 27.2 (×3), 25.6, 24.5, 23.3, 226, 14.1; Electrospray MS (+ve): Molecular weight for C44H80NO2 (M+H)+ Calc. 654.6, Found 654.6.

Formulations prepared by either the standard or extrusion-free method can be characterized in similar manners. For example, formulations are typically characterized by visual inspection. They should be whitish translucent solutions free from aggregates or sediment. Particle size and particle size distribution of lipid-nanoparticles can be measured by light scattering using, for example, a Malvern Zetasizer Nano ZS (Malvern, USA). Particles should be about 20-300 nm, such as 40-100 nm in size. The particle size distribution should be unimodal. The total dsRNA concentration in the formulation, as well as the entrapped fraction, is estimated using a dye exclusion assay. A sample of the formulated dsRNA can be incubated with an RNA-binding dye, such as Ribogreen (Molecular Probes) in the presence or absence of a formulation disrupting surfactant, e.g., 0.5% Triton-X100. The total dsRNA in the formulation can be determined by the signal from the sample containing the surfactant, relative to a standard curve. The entrapped fraction is determined by subtracting the "free" dsRNA content (as measured by the signal in the absence of surfactant) from the total dsRNA content. Percent entrapped dsRNA is typically >85%. For SNALP formulation, the particle size is at least 30 nm, at least 40 nm, at least 50 nm, at least 60 nm, at least 70 nm, at least 80 nm, at least 90 nm, at least 100 nm, at least 110 nm, and at least 120 nm. The suitable range is typically about at least 50 nm to about at least 110 nm, about at least 60 nm to about at least 100 nm, or about at least 80 nm to about at least 90 nm.

Compositions and formulations for oral administration include powders or granules, microparticulates, nanoparticulates, suspensions or solutions in water or non-aqueous media, capsules, gel capsules, sachets, tablets or minitablets. Thickeners, flavoring agents, diluents, emulsifiers, dispersing aids or binders may be desirable. In some embodiments, oral formulations are those in which dsRNAs featured in the disclosure are administered in conjunction with one or more penetration enhancers surfactants and chelators. Suitable surfactants include fatty acids and/or esters or salts thereof, bile acids and/or salts thereof. Suitable bile acids/salts include chenodeoxycholic acid (CDCA) and ursodeoxychenodeoxycholic acid (UDCA), cholic acid, dehydrocholic acid, deoxycholic acid, glucholic acid, glycholic acid, glycodeoxycholic acid, taurocholic acid, taurodeoxycholic acid, sodium tauro-24,25-dihydro-fusidate and sodium glycodihydrofusidate. Suitable fatty acids include arachidonic acid, undecanoic acid, oleic acid, lauric acid, caprylic acid, capric acid, myristic acid, palmitic acid, stearic acid, linoleic acid, linolenic acid, dicaprate, tricaprate, monoolein, dilaurin, glyceryl 1-monocaprate, 1-dodecylazacycloheptan-2-one, an acylcarnitine, an acylcholine, or a monoglyceride, a diglyceride or a pharmaceutically acceptable salt thereof (e.g., sodium). In some embodiments, combinations of penetration enhancers are used, for example, fatty acids/salts in combination with bile acids/salts. One exemplary combination is the sodium salt of lauric acid, capric acid and UDCA. Further penetration enhancers include polyoxyethylene-9-lauryl ether, polyoxyethylene-20-cetyl ether. DsRNAs featured in the disclosure may be delivered orally, in granular form including sprayed dried particles, or complexed to form micro or nanoparticles. DsRNA complexing agents include poly-amino acids; polyimines; polyacrylates; polyalkylacrylates, polyoxethanes, polyalkylcyanoacrylates; cationized gelatins, albumins, starches, acrylates, polyethyleneglycols (PEG) and starches; polyalkylcyanoacrylates; DEAE-derivatized polyimines, pollulans, celluloses and starches. Suitable complexing agents include chitosan, N-trimethylchitosan, poly-L-lysine, polyhistidine, polyornithine, polyspermines, protamine, polyvinylpyridine, polythiodiethylaminomethylethylene P(TDAE), polyaminostyrene (e.g., p-amino), poly(methylcyanoacrylate), poly(ethylcyanoacrylate), poly(butylcyanoacrylate), poly(isobutylcyanoacrylate), poly(isohexylcynaoacrylate), DEAE-methacrylate, DEAE-hexylacrylate, DEAE-acrylamide, DEAE-albumin and DEAE-dextran, polymethylacrylate, polyhexylacrylate, poly(D,L-lactic acid), poly(DL-lactic-co-glycolic acid (PLGA), alginate, and polyethyleneglycol (PEG). Oral formulations for dsRNAs and their preparation are described in detail in U.S. Pat. No. 6,887,906, US Publn. No. 20030027780, and U.S. Pat. No. 6,747,014, each of which is incorporated herein by reference.

Compositions and formulations for parenteral, intraparenchymal (into the brain), intrathecal, intravitreal, intraventricular, or intrahepatic administration may include sterile aqueous solutions which may also contain buffers, diluents and other suitable additives such as, but not limited to, penetration enhancers, carrier compounds and other pharmaceutically acceptable carriers or excipients.

Pharmaceutical compositions of the present disclosure include, but are not limited to, solutions, emulsions, and liposome-containing formulations. These compositions may be generated from a variety of components that include, but are not limited to, preformed liquids, self-emulsifying solids and self-emulsifying semisolids.

The pharmaceutical formulations featured in the present disclosure, which may conveniently be presented in unit dosage form, may be prepared according to conventional techniques well known in the pharmaceutical industry. Such techniques include the step of bringing into association the active ingredients with the pharmaceutical carrier(s) or excipient(s). In general, the formulations are prepared by uniformly and intimately bringing into association the active ingredients with liquid carriers or finely divided solid carriers or both, and then, if necessary, shaping the product.

The compositions featured in the present disclosure may be formulated into any of many possible dosage forms such as, but not limited to, tablets, capsules, gel capsules, liquid syrups, soft gels, suppositories, and enemas. The compositions may also be formulated as suspensions in aqueous, non-aqueous or mixed media. Aqueous suspensions may further contain substances which increase the viscosity of the suspension including, for example, sodium carboxymethylcellulose, sorbitol and/or dextran. The suspension may also contain stabilizers.

Additional Formulations

Emulsions

The compositions of the present disclosure may be prepared and formulated as emulsions. Emulsions are typically heterogeneous systems of one liquid dispersed in another in the form of droplets usually exceeding 0.1 μm in diameter (see e.g., Ansel's Pharmaceutical Dosage Forms and Drug Delivery Systems, Allen, L V., Popovich N G., and Ansel H C., 2004, Lippincott Williams & Wilkins (8th ed.), New York, N.Y.; Idson, in *Pharmaceutical Dosage Forms*, Lieberman, Rieger and Banker (Eds.), 1988, Marcel Dekker, Inc., New York, N.Y., volume 1, p. 199; Rosoff, in Pharmaceutical Dosage Forms, Lieberman, Rieger and Banker (Eds.), 1988, Marcel Dekker, Inc., New York, N.Y., Volume 1, p. 245; Block in *Pharmaceutical Dosage Forms*, Lieberman, Rieger and Banker (Eds.), 1988, Marcel Dekker, Inc., New York, N.Y., volume 2, p. 335; Higuchi et al., in Remington's Pharmaceutical Sciences, Mack Publishing Co., Easton, Pa., 1985, p. 301). Emulsions are often biphasic systems comprising two immiscible liquid phases intimately mixed and dispersed with each other. In general, emulsions may be of either the water-in-oil (w/o) or the oil-in-water (o/w) variety. When an aqueous phase is finely divided into and dispersed as minute droplets into a bulk oily phase, the resulting composition is called a water-in-oil (w/o) emulsion. Alternatively, when an oily phase is finely divided into and dispersed as minute droplets into a bulk aqueous phase, the resulting composition is called an oil-in-water (o/w) emulsion. Emulsions may contain additional components in addition to the dispersed phases, and the active drug which may be present as a solution in either the aqueous phase, oily phase or itself as a separate phase. Pharmaceutical excipients such as emulsifiers, stabilizers, dyes, and anti-oxidants may also be present in emulsions as needed. Pharmaceutical emulsions may also be multiple emulsions that are comprised of more than two phases such as, for example, in the case of oil-in-water-in-oil (o/w/o) and water-in-oil-in-water (w/o/w) emulsions. Such complex formulations often provide certain advantages that simple binary emulsions do not. Multiple emulsions in which individual oil droplets of an o/w emulsion enclose small water droplets constitute a w/o/w emulsion. Likewise, a system of oil droplets enclosed in globules of water stabilized in an oily continuous phase provides an o/w/o emulsion.

Emulsions are characterized by little or no thermodynamic stability. Often, the dispersed or discontinuous phase of the emulsion is well dispersed into the external or continuous phase and maintained in this form through the means of emulsifiers or the viscosity of the formulation. Either of the phases of the emulsion may be a semisolid or a solid, as is the case of emulsion-style ointment bases and creams. Other means of stabilizing emulsions entail the use of emulsifiers that may be incorporated into either phase of the emulsion. Emulsifiers may broadly be classified into four categories: synthetic surfactants, naturally occurring emulsifiers, absorption bases, and finely dispersed solids (see e.g., Ansel's *Pharmaceutical Dosage Forms and Drug Delivery Systems*, Allen, L V., Popovich N G., and Ansel H C., 2004, Lippincott Williams & Wilkins (8th ed.), New York, N.Y.; Idson, in *Pharmaceutical Dosage Forms*, Lieberman, Rieger and Banker (Eds.), 1988, Marcel Dekker, Inc., New York, N.Y., volume 1, p. 199).

Synthetic surfactants, also known as surface active agents, have found wide applicability in the formulation of emulsions and have been reviewed in the literature (see e.g., Ansel's *Pharmaceutical Dosage Forms and Drug Delivery Systems*, Allen, L V., Popovich N G., and Ansel H C., 2004, Lippincott Williams & Wilkins (8th ed.), New York, NY; Rieger, in *Pharmaceutical Dosage Forms*, Lieberman, Rieger and Banker (Eds.), 1988, Marcel Dekker, Inc., New York, N.Y., volume 1, p. 285; Idson, in *Pharmaceutical Dosage Forms*, Lieberman, Rieger and Banker (Eds.), Marcel Dekker, Inc., New York, N.Y., 1988, volume 1, p. 199). Surfactants are typically amphiphilic and comprise a hydrophilic and a hydrophobic portion. The ratio of the hydrophilic to the hydrophobic nature of the surfactant has been termed the hydrophile/lipophile balance (HLB) and is a valuable tool in categorizing and selecting surfactants in the preparation of formulations. Surfactants may be classified into different classes based on the nature of the hydrophilic group: nonionic, anionic, cationic and amphoteric (see e.g., Ansel's Pharmaceutical Dosage Forms and Drug Delivery Systems, Allen, L V., Popovich N G., and Ansel H C., 2004, Lippincott Williams & Wilkins (8th ed.), New York, NY Rieger, in *Pharmaceutical Dosage Forms*, Lieberman, Rieger and Banker (Eds.), 1988, Marcel Dekker, Inc., New York, N.Y., volume 1, p. 285).

Naturally occurring emulsifiers used in emulsion formulations include lanolin, beeswax, phosphatides, lecithin and acacia. Absorption bases possess hydrophilic properties such that they can soak up water to form w/o emulsions yet retain their semisolid consistencies, such as anhydrous lanolin and hydrophilic petrolatum. Finely divided solids have also been used as good emulsifiers especially in combination with surfactants and in viscous preparations. These include polar inorganic solids, such as heavy metal hydroxides, nonswelling clays such as bentonite, attapulgite, hectorite, kaolin, montmorillonite, colloidal aluminum silicate and colloidal magnesium aluminum silicate, pigments and nonpolar solids such as carbon or glyceryl tristearate.

A large variety of non-emulsifying materials are also included in emulsion formulations and contribute to the properties of emulsions. These include fats, oils, waxes, fatty acids, fatty alcohols, fatty esters, humectants, hydrophilic colloids, preservatives and antioxidants (Block, in *Pharmaceutical Dosage Forms*, Lieberman, Rieger and Banker (Eds.), 1988, Marcel Dekker, Inc., New York, N.Y., volume 1, p. 335; Idson, in *Pharmaceutical Dosage Forms*, Lieberman, Rieger and Banker (Eds.), 1988, Marcel Dekker, Inc., New York, N.Y., volume 1, p. 199).

Hydrophilic colloids or hydrocolloids include naturally occurring gums and synthetic polymers such as polysaccharides (for example, acacia, agar, alginic acid, carrageenan, guar gum, karaya gum, and tragacanth), cellulose derivatives (for example, carboxymethylcellulose and carboxypropylcellulose), and synthetic polymers (for example, carbomers, cellulose ethers, and carboxyvinyl polymers). These disperse or swell in water to form colloidal solutions that stabilize emulsions by forming strong interfacial films around the dispersed-phase droplets and by increasing the viscosity of the external phase.

Since emulsions often contain a number of ingredients such as carbohydrates, proteins, sterols and phosphatides that may readily support the growth of microbes, these formulations often incorporate preservatives. Commonly used preservatives included in emulsion formulations include methyl paraben, propyl paraben, quaternary ammonium salts, benzalkonium chloride, esters of p-hydroxybenzoic acid, and boric acid. Antioxidants are also commonly added to emulsion formulations to prevent deterioration of the formulation. Antioxidants used may be free radical scavengers such as tocopherols, alkyl gallates, butylated hydroxyanisole, butylated hydroxytoluene, or reducing agents such as ascorbic acid and sodium metabisulfite, and antioxidant synergists such as citric acid, tartaric acid, and lecithin.

The application of emulsion formulations via dermatological, oral and parenteral routes and methods for their manufacture have been reviewed in the literature (see e.g., Ansel's *Pharmaceutical Dosage Forms and Drug Delivery Systems*, Allen, L V., Popovich N G., and Ansel H C., 2004, Lippincott Williams & Wilkins (8th ed.), New York, NY; Idson, in *Pharmaceutical Dosage Forms*, Lieberman, Rieger and Banker (Eds.), 1988, Marcel Dekker, Inc., New York, N.Y., volume 1, p. 199). Emulsion formulations for oral delivery have been very widely used because of ease of formulation, as well as efficacy from an absorption and bioavailability standpoint (see e.g., Ansel's *Pharmaceutical Dosage Forms and Drug Delivery Systems*, Allen, L V., Popovich N G., and Ansel H C., 2004, Lippincott Williams & Wilkins (8th ed.), New York, NY; Rosoff, in *Pharmaceutical Dosage Forms*, Lieberman, Rieger and Banker (Eds.), 1988, Marcel Dekker, Inc., New York, N.Y., volume 1, p. 245; Idson, in *Pharmaceutical Dosage Forms*, Lieberman, Rieger and Banker (Eds.), 1988, Marcel Dekker, Inc., New York, N.Y., volume 1, p. 199). Mineral-oil base laxatives, oil-soluble vitamins and high fat nutritive preparations are among the materials that have commonly been administered orally as o/w emulsions.

In some embodiments of the present disclosure, the compositions of iRNAs and nucleic acids are formulated as microemulsions. A microemulsion may be defined as a system of water, oil and amphiphile which is a single optically isotropic and thermodynamically stable liquid solution (see e.g., Ansel's *Pharmaceutical Dosage Forms and Drug Delivery Systems*, Allen, L V., Popovich N G., and Ansel H C., 2004, Lippincott Williams & Wilkins (8th ed.), New York, NY; Rosoff, in *Pharmaceutical Dosage Forms*, Lieberman, Rieger and Banker (Eds.), 1988, Marcel Dekker, Inc., New York, N.Y., volume 1, p. 245). Typically, microemulsions are systems that are prepared by first dispersing an oil in an aqueous surfactant solution and then adding a sufficient amount of a fourth component, generally an intermediate chain-length alcohol to form a transparent system. Therefore, microemulsions have also been described as thermodynamically stable, isotopically clear dispersions of two immiscible liquids that are stabilized by interfacial films of surface-active molecules (Leung and Shah, in: *Controlled Release of Drugs: Polymers and Aggregate Systems*, Rosoff, M., Ed., 1989, VCH Publishers, New York, pages 185-215). Microemulsions commonly are prepared via a combination of three to five components that include oil, water, surfactant, cosurfactant and electrolyte. Whether the microemulsion is of the water-in-oil (w/o) or an oil-in-water (o/w) type is dependent on the properties of the oil and surfactant used and on the structure and geometric packing of the polar heads and hydrocarbon tails of the surfactant molecules (Schott, in Remington's *Pharmaceutical Sciences*, Mack Publishing Co., Easton, Pa., 1985, p. 271).

The phenomenological approach utilizing phase diagrams has been extensively studied and has yielded a comprehensive knowledge, to one skilled in the art, of how to formulate microemulsions (see e.g., Ansel's *Pharmaceutical Dosage Forms and Drug Delivery Systems*, Allen, L V., Popovich N G., and Ansel H C., 2004, Lippincott Williams & Wilkins (8th ed.), New York, NY; Rosoff, in *Pharmaceutical Dosage Forms*, Lieberman, Rieger and Banker (Eds.), 1988, Marcel Dekker, Inc., New York, N.Y., volume 1, p. 245; Block, in *Pharmaceutical Dosage Forms*, Lieberman, Rieger and Banker (Eds.), 1988, Marcel Dekker, Inc., New York, N.Y., volume 1, p. 335). Compared to conventional emulsions, microemulsions offer the advantage of solubilizing water-insoluble drugs in a formulation of thermodynamically stable droplets that are formed spontaneously.

Surfactants used in the preparation of microemulsions include, but are not limited to, ionic surfactants, non-ionic surfactants, Brij 96, polyoxyethylene oleyl ethers, polyglycerol fatty acid esters, tetraglycerol monolaurate (ML310), tetraglycerol monooleate (MO310), hexaglycerol monooleate (P0310), hexaglycerol pentaoleate (PO500), decaglycerol monocaprate (MCA750), decaglycerol monooleate (MO750), decaglycerol sequioleate (SO750), decaglycerol decaoleate (DA0750), alone or in combination with cosurfactants. The cosurfactant, usually a short-chain alcohol such as ethanol, 1-propanol, and 1-butanol, serves to increase the interfacial fluidity by penetrating into the surfactant film and consequently creating a disordered film because of the void space generated among surfactant molecules. Microemulsions may, however, be prepared without the use of cosurfactants and alcohol-free self-emulsifying microemulsion systems are known in the art. The aqueous phase may typically be, but is not limited to, water, an aqueous solution of the drug, glycerol, PEG300, PEG400, polyglycerols, propylene glycols, and derivatives of ethylene glycol. The oil phase may include, but is not limited to, materials such as Captex 300, Captex 355, Capmul MCM, fatty acid esters, medium chain (C8-C12) mono, di, and tri-glycerides, polyoxyethylated glyceryl fatty acid esters, fatty alcohols, polyglycolized glycerides, saturated polyglycolized C8-C10 glycerides, vegetable oils and silicone oil.

Microemulsions are particularly of interest from the standpoint of drug solubilization and the enhanced absorption of drugs. Lipid based microemulsions (both o/w and w/o) have been proposed to enhance the oral bioavailability of drugs, including peptides (see e.g., U.S. Pat. Nos. 6,191,105; 7,063,860; 7,070,802; 7,157,099; Constantinides et al., *Pharmaceutical Research,* 1994, 11, 1385-1390; Ritschel, *Meth. Find. Exp. Clin. Pharmacol.,* 1993, 13, 205). Microemulsions afford advantages of improved drug solubilization, protection of drug from enzymatic hydrolysis, possible enhancement of drug absorption due to surfactant-induced alterations in membrane fluidity and permeability, ease of preparation, ease of oral administration over solid dosage forms, improved clinical potency, and decreased toxicity (see e.g., U.S. Pat. Nos. 6,191,105; 7,063,860; 7,070,802; 7,157,099; Constantinides et al., *Pharmaceutical Research,* 1994, 11, 1385; Ho et al., *J. Pharm. Sci.,* 1996, 85, 138-143). Often microemulsions may form spontaneously when their components are brought together at ambient temperature. This may be particularly advantageous when formulating thermolabile drugs, peptides or iRNAs. Microemulsions have also been effective in the transdermal delivery of active components in both cosmetic and pharmaceutical applications. It is expected that the microemulsion compositions and formulations of the present disclosure will facilitate the increased systemic absorption of iRNAs and nucleic acids from the gastrointestinal tract, as well as improve the local cellular uptake of iRNAs and nucleic acids.

Microemulsions of the present disclosure may also contain additional components and additives such as sorbitan monostearate (Grill 3), Labrasol, and penetration enhancers to improve the properties of the formulation and to enhance the absorption of the iRNAs and nucleic acids of the present disclosure. Penetration enhancers used in the microemulsions of the present disclosure may be classified as belonging to one of five broad categories—surfactants, fatty acids, bile salts, chelating agents, and non-chelating non-surfactants (Lee et al., *Critical Reviews in Therapeutic Drug Carrier Systems,* 1991, p. 92). Each of these classes has been discussed above.

Penetration Enhancers

In some embodiments, the present disclosure employs various penetration enhancers to effect the efficient delivery of nucleic acids, particularly iRNAs, to the skin of animals. Most drugs are present in solution in both ionized and nonionized forms. However, usually only lipid soluble or lipophilic drugs readily cross cell membranes. It has been discovered that even non-lipophilic drugs may cross cell membranes if the membrane to be crossed is treated with a penetration enhancer. In addition to aiding the diffusion of non-lipophilic drugs across cell membranes, penetration enhancers also enhance the permeability of lipophilic drugs.

Penetration enhancers may be classified as belonging to one of five broad categories, i.e., surfactants, fatty acids, bile salts, chelating agents, and non-chelating non-surfactants (see e.g., Malmsten, M. Surfactants and polymers in drug delivery, *Informa Health Care*, New York, NY, 2002; Lee et al., *Critical Reviews in Therapeutic Drug Carrier Systems,* 1991, p. 92). Each of the above-mentioned classes of penetration enhancers are described below in greater detail.

Surfactants: In connection with the present disclosure, surfactants (or "surface-active agents") are chemical entities which, when dissolved in an aqueous solution, reduce the surface tension of the solution or the interfacial tension between the aqueous solution and another liquid, with the result that absorption of iRNAs through the mucosa is enhanced. In addition to bile salts and fatty acids, these penetration enhancers include, for example, sodium lauryl sulfate, polyoxyethylene-9-lauryl ether and polyoxyethylene-20-cetyl ether) (see e.g., Malmsten, M. Surfactants and polymers in drug delivery, Informa Health Care, New York, NY, 2002; Lee et al., *Critical Reviews in Therapeutic Drug Carrier Systems,* 1991, p. 92); and perfluorochemical emulsions, such as FC-43. Takahashi et al., *J. Pharm. Pharmacol.,* 1988, 40, 252).

Fatty acids: Various fatty acids and their derivatives which act as penetration enhancers include, for example, oleic acid, lauric acid, capric acid (n-decanoic acid), myristic acid, palmitic acid, stearic acid, linoleic acid, linolenic acid, dicaprate, tricaprate, monoolein (1-monooleoyl-rac-glycerol), dilaurin, caprylic acid, arachidonic acid, glycerol 1-monocaprate, 1-dodecylazacycloheptan-2-one, acylcarnitines, acylcholines, $C_{1-20}$ alkyl esters thereof (e.g., methyl, isopropyl and t-butyl), and mono- and di-glycerides thereof (i.e., oleate, laurate, caprate, myristate, palmitate, stearate, linoleate, etc.) (see e.g., Touitou, E., et al. *Enhancement in Drug Delivery*, CRC Press, Danvers, MA, 2006; Lee et al., *Critical Reviews in Therapeutic Drug Carrier Systems,* 1991, p. 92; Muranishi, *Critical Reviews in Therapeutic Drug Carrier Systems,* 1990, 7, 1-33; El Hariri et al., *J. Pharm. Pharmacol.,* 1992, 44, 651-654).

Bile salts: The physiological role of bile includes the facilitation of dispersion and absorption of lipids and fat-soluble vitamins (see e.g., Malmsten, M. Surfactants and polymers in drug delivery, *Informa Health Care*, New York, NY, 2002; Brunton, Chapter 38 in: Goodman & Gilman's *The Pharmacological Basis of Therapeutics,* 9th Ed., Hardman et al. Eds., McGraw-Hill, New York, 1996, pp. 934-935). Various natural bile salts, and their synthetic derivatives, act as penetration enhancers. Thus, the term "bile salts" includes any of the naturally occurring components of bile as well as any of their synthetic derivatives. Suitable bile salts include, for example, cholic acid (or its pharmaceutically acceptable sodium salt, sodium cholate), dehydrocholic acid (sodium dehydrocholate), deoxycholic acid (sodium deoxycholate), glucholic acid (sodium glucholate), glycholic acid (sodium glycocholate), glycodeoxycholic acid (sodium glycodeoxycholate), taurocholic acid (sodium taurocholate), taurodeoxycholic acid (sodium taurodeoxycholate), chenodeoxycholic acid (sodium chenodeoxycholate), ursodeoxycholic acid (UDCA), sodium tauro-24,25-dihydro-fusidate (STDHF), sodium glycodihydrofusidate and polyoxyethylene-9-lauryl ether (POE) (see e.g., Malmsten, M. Surfactants and polymers in drug delivery, Informa Health Care, New York, NY, 2002; Lee et al., *Critical Reviews in Therapeutic Drug Carrier Systems,* 1991, page 92; Swinyard, Chapter 39 In: *Remington's Pharmaceutical Sciences,* 18th Ed., Gennaro, ed., Mack Publishing Co., Easton, Pa., 1990, pages 782-783; Muranishi, *Critical Reviews in Therapeutic Drug Carrier Systems,* 1990, 7, 1-33; Yamamoto et al., *J. Pharm. Exp. Ther.,* 1992, 263, 25; Yamashita et al., *J. Pharm. Sci.,* 1990, 79, 579-583).

Chelating Agents: Chelating agents, as used in connection with the present disclosure, can be defined as compounds that remove metallic ions from solution by forming complexes therewith, with the result that absorption of iRNAs through the mucosa is enhanced. With regards to their use as penetration enhancers in the present disclosure, chelating agents have the added advantage of also serving as DNase inhibitors, as most characterized DNA nucleases require a divalent metal ion for catalysis and are thus inhibited by chelating agents (Jarrett, *J. Chromatogr.,* 1993, 618, 315-339). Suitable chelating agents include but are not limited to disodium ethylenediaminetetraacetate (EDTA), citric acid, salicylates (e.g., sodium salicylate, 5-methoxysalicylate and homovanilate), N-acyl derivatives of collagen, laureth-9 and N-amino acyl derivatives of β-diketones (enamines) (see e.g., Katdare, A. et al., *Excipient development for pharmaceutical, biotechnology, and drug delivery*, CRC Press, Danvers, MA, 2006; Lee et al., *Critical Reviews in Therapeutic Drug Carrier Systems,* 1991, page 92; Muranishi, *Critical Reviews in Therapeutic Drug Carrier Systems,* 1990, 7, 1-33; Buur et al., *J. Control Rel.,* 1990, 14, 43-51).

Non-chelating non-surfactants: As used herein, non-chelating non-surfactant penetration enhancing compounds can be defined as compounds that demonstrate insignificant activity as chelating agents or as surfactants but that nonetheless enhance absorption of iRNAs through the alimentary mucosa (see e.g., Muranishi, *Critical Reviews in Therapeutic Drug Carrier Systems,* 1990, 7, 1-33). This class of penetration enhancers include, for example, unsaturated cyclic ureas, 1-alkyl- and 1-alkenylazacyclo-alkanone derivatives (Lee et al., *Critical Reviews in Therapeutic Drug Carrier Systems,* 1991, page 92); and non-steroidal anti-inflammatory agents such as diclofenac sodium, indomethacin and phenylbutazone (Yamashita et al., *J. Pharm. Pharmacol.,* 1987, 39, 621-626).

Agents that enhance uptake of iRNAs at the cellular level may also be added to the pharmaceutical and other compositions of the present disclosure. For example, cationic lipids, such as lipofectin (Junichi et al, U.S. Pat. No. 5,705,188), cationic glycerol derivatives, and polycationic molecules, such as polylysine (Lollo et al., PCT Application WO 97/30731), are also known to enhance the cellular uptake of dsRNAs. Examples of commercially available transfection reagents include, for example Lipofectamine™ (Invitrogen; Carlsbad, CA), Lipofectamine2000™ (Invitrogen; Carlsbad, CA), 293Fectin™ (Invitrogen; Carlsbad, CA), Cellfectin™ (Invitrogen; Carlsbad, CA), DMRIE-C™ (Invitrogen; Carlsbad, CA), FreeStyle™ MAX (Invitrogen; Carlsbad, CA), Lipofectamine™ 2000 CD (Invitrogen; Carlsbad, CA), Lipofectamine™ (Invitrogen; Carlsbad, CA), RNAiMAX (Invitrogen; Carlsbad, CA), Oligofectamine™ (Invitrogen; Carlsbad, CA), Optifect™ (Invitrogen; Carlsbad, CA), X-tremeGENE Q2 Transfection Reagent (Roche; Grenzacherstrasse, Switzerland), DOTAP Liposomal Transfection Reagent (Grenzacherstrasse, Switzerland), DOSPER Liposomal Transfection Reagent (Grenzacherstrasse, Switzerland), or Fugene (Grenzacherstrasse, Switzerland), Transfectam® Reagent (Promega; Madison, WI), TransFast™ Transfection Reagent (Promega; Madison, WI), Tfx™-20 Reagent (Promega; Madison, WI), Tfx™-50 Reagent (Promega; Madison, WI), DreamFect™ (OZ Biosciences; Marseille, France), EcoTransfect (OZ Biosciences; Marseille, France), TransPassa D1 Transfection Reagent (New England Biolabs; Ipswich, MA, USA), LyoVec™/

LipoGen™ (Invivogen; San Diego, CA, USA), PerFectin Transfection Reagent (Genlantis; San Diego, CA, USA), NeuroPORTER Transfection Reagent (Genlantis; San Diego, CA, USA), GenePORTER Transfection reagent (Genlantis; San Diego, CA, USA), GenePORTER 2 Transfection reagent (Genlantis; San Diego, CA, USA), Cytofectin Transfection Reagent (Genlantis; San Diego, CA, USA), BaculoPORTER Transfection Reagent (Genlantis; San Diego, CA, USA), TroganPORTER™ transfection Reagent (Genlantis; San Diego, CA, USA), RiboFect (Bioline; Taunton, MA, USA), PlasFect (Bioline; Taunton, MA, USA), UniFECTOR (B-Bridge International; Mountain View, CA, USA), SureFECTOR (B-Bridge International; Mountain View, CA, USA), or HiFect™ (B-Bridge International, Mountain View, CA, USA), among others.

Other agents may be utilized to enhance the penetration of the administered nucleic acids, including glycols such as ethylene glycol and propylene glycol, pyrrols such as 2-pyrrol, azones, and terpenes such as limonene and menthone.

Carriers

Certain compositions of the present disclosure also incorporate carrier compounds in the formulation. As used herein, "carrier compound" can refer to a nucleic acid, or analog thereof, which is inert (i.e., does not possess biological activity per se) but is recognized as a nucleic acid by in vivo processes that reduce the bioavailability of a nucleic acid having biological activity by, for example, degrading the biologically active nucleic acid or promoting its removal from circulation. The coadministration of a nucleic acid and a carrier compound, typically with an excess of the latter substance, can result in a substantial reduction of the amount of nucleic acid recovered in the liver, kidney or other extracirculatory reservoirs, presumably due to competition between the carrier compound and the nucleic acid for a common receptor. For example, the recovery of a partially phosphorothioate dsRNA in hepatic tissue can be reduced when it is coadministered with polyinosinic acid, dextran sulfate, polycytidic acid or 4-acetamido-4'isothiocyano-stilbene-2,2'-disulfonic acid (Miyao et al., *DsRNA Res. Dev.,* 1995, 5, 115-121; Takakura et al., *DsRNA & Nucl. Acid Drug Dev.,* 1996, 6, 177-183).

Excipients

In contrast to a carrier compound, a pharmaceutical carrier or excipient may comprise, e.g., a pharmaceutically acceptable solvent, suspending agent or any other pharmacologically inert vehicle for delivering one or more nucleic acids to an animal. The excipient may be liquid or solid and is selected, with the planned manner of administration in mind, so as to provide for the desired bulk, consistency, etc., when combined with a nucleic acid and the other components of a given pharmaceutical composition. Typical pharmaceutical carriers include, but are not limited to, binding agents (e.g., pregelatinized maize starch, polyvinylpyrrolidone or hydroxypropyl methylcellulose, etc.); fillers (e.g., lactose and other sugars, microcrystalline cellulose, pectin, gelatin, calcium sulfate, ethyl cellulose, polyacrylates or calcium hydrogen phosphate, etc.); lubricants (e.g., magnesium stearate, talc, silica, colloidal silicon dioxide, stearic acid, metallic stearates, hydrogenated vegetable oils, corn starch, polyethylene glycols, sodium benzoate, sodium acetate, etc.); disintegrants (e.g., starch, sodium starch glycolate, etc.); and wetting agents (e.g., sodium lauryl sulphate, etc).

Pharmaceutically acceptable organic or inorganic excipients suitable for non-parenteral administration which do not deleteriously react with nucleic acids can also be used to formulate the compositions of the present disclosure. Suitable pharmaceutically acceptable carriers include, but are not limited to, water, salt solutions, alcohols, polyethylene glycols, gelatin, lactose, amylose, magnesium stearate, talc, silicic acid, viscous paraffin, hydroxymethylcellulose, polyvinylpyrrolidone and the like.

Formulations for topical administration of nucleic acids may include sterile and non-sterile aqueous solutions, non-aqueous solutions in common solvents such as alcohols, or solutions of the nucleic acids in liquid or solid oil bases. The solutions may also contain buffers, diluents and other suitable additives. Pharmaceutically acceptable organic or inorganic excipients suitable for non-parenteral administration which do not deleteriously react with nucleic acids can be used.

Suitable pharmaceutically acceptable excipients include, but are not limited to, water, salt solutions, alcohol, polyethylene glycols, gelatin, lactose, amylose, magnesium stearate, talc, silicic acid, viscous paraffin, hydroxymethylcellulose, polyvinylpyrrolidone and the like.

Other Components

The compositions of the present disclosure may additionally contain other adjunct components conventionally found in pharmaceutical compositions, e.g., at their art-established usage levels. Thus, for example, the compositions may contain additional, compatible, pharmaceutically-active materials such as, for example, antipruritics, astringents, local anesthetics or anti-inflammatory agents, or may contain additional materials useful in physically formulating various dosage forms of the compositions of the present disclosure, such as dyes, flavoring agents, preservatives, antioxidants, opacifiers, thickening agents and stabilizers. However, such materials, when added, should not unduly interfere with the biological activities of the components of the compositions of the present disclosure. The formulations can be sterilized and, if desired, mixed with auxiliary agents, e.g., lubricants, preservatives, stabilizers, wetting agents, emulsifiers, salts for influencing osmotic pressure, buffers, colorings, flavorings and/or aromatic substances and the like which do not deleteriously interact with the nucleic acid(s) of the formulation.

Aqueous suspensions may contain substances that increase the viscosity of the suspension including, for example, sodium carboxymethylcellulose, sorbitol and/or dextran. The suspension may also contain stabilizers.

In some embodiments, pharmaceutical compositions featured in the disclosure include (a) one or more iRNA compounds and (b) one or more biologic agents which function by a non-RNAi mechanism. Examples of such biologic agents include agents that interfere with an interaction of SCN9A and at least one SCN9A binding partner.

Toxicity and therapeutic efficacy of such compounds can be determined by standard pharmaceutical procedures in cell cultures or experimental animals, e.g., for determining the LD50 (the dose lethal to 50% of the population) and the ED50 (the dose therapeutically effective in 50% of the population). The dose ratio between toxic and therapeutic effects is the therapeutic index and it can be expressed as the ratio LD50/ED50. Compounds that exhibit high therapeutic indices are typical.

The data obtained from cell culture assays and animal studies can be used in formulating a range of dosage for use in humans. The dosage of compositions featured in the disclosure lies generally within a range of circulating concentrations that include the ED50 with little or no toxicity. The dosage may vary within this range depending upon the dosage form employed and the route of administration utilized. For any compound used in the methods featured in the disclosure, the therapeutically effective dose can be estimated initially from cell culture assays. A dose may be formulated in animal models to achieve a circulating plasma concentration range of the compound or, when appropriate, of the polypeptide product of a target sequence (e.g., achieving a decreased concentration of the polypeptide) that includes the IC50 (i.e., the concentration of the test compound which achieves a half-maximal inhibition of symptoms) as determined in cell culture. Such information can be used to more accurately determine useful doses in humans. Levels in plasma may be measured, for example, by high performance liquid chromatography.

In addition to their administration, as discussed above, the iRNAs featured in the disclosure can be administered in combination with other known agents effective in treatment of diseases or disorders related to SCN9A expression (e.g., pain, e.g., chronic pain or pain-related disorder). In any event, the administering physician can adjust the amount and timing of iRNA administration on the basis of results observed using standard measures of efficacy known in the art or described herein.

Methods of Treating Disorders Related to Expression of SCN9A

The present disclosure relates to the use of an iRNA targeting SCN9A to inhibit SCN9A expression and/or to treat a disease, disorder, or pathological process that is related to SCN9A expression (e.g., pain, e.g., chronic pain or pain-related disorder).

In some aspects, a method of treatment of a disorder related to expression of SCN9A is provided, the method comprising administering an iRNA (e.g., a dsRNA) disclosed herein to a subject in need thereof. In some embodiments, the iRNA inhibits (decreases) SCN9A expression.

In some embodiments, the subject is an animal that serves as a model for a disorder related to SCN9A expression, e.g., pain, e.g., chronic pain or pain-related disorder, e.g., inflammatory pain, neuropathic pain, pain hypersensitivity, pain hyposensitivity, inability to sense pain, primary erythromelalgia (PE), paroxysmal extreme pain disorder (PEPD), small fiber neuropathy (SFN), trigeminal neuralgia (TN), and pain associated with, e.g., cancer, arthritis, diabetes, traumatic injury and viral infections.

Chronic Pain and Pain-Related Disorders

In some embodiments, the disorder related to SCN9A expression is pain, e.g., chronic pain or pain related disorders, e.g., pain hypersensitivity or hyposensitivity. Non-limiting examples of pain-related disorders that are treatable using the methods described herein include inflammatory pain, neuropathic pain, pain insensitivity, primary erythromelalgia (PE), paroxysmal extreme pain disorder (PEPD), small fiber neuropathy (SFN), trigeminal neuralgia (TN), and pain associated with cancer, arthritis, diabetes, traumatic injury, and viral infections. In some embodiments, the pain-related disorder is an inherited pain-related disorder, e.g., PE and PEPD.

Clinical and pathological features of pain-related disorders include, but are not limited to, burning pain, redness of skin, flushing, warmth of extremities, joint pain, severe pain, e.g., periods of severe pain in the lower body, upper body (e.g., pain in the eyes or jaw), or extremities (e.g., hands and feet), inability to sense pain, fatigue, and/or insomnia.

In some embodiments, the subject with the pain, e.g., chronic pain, or pain-related disorder is less than 18 years old. In some embodiments, the subject with the pain, e.g., chronic pain, or pain-related disorder is an adult. In some embodiments, the subject has, or is identified as having, elevated levels of SCN9A mRNA or protein relative to a reference level (e.g., a level of SCN9A that is greater than a reference level).

In some embodiments, the pain, e.g., chronic pain, or the pain-related disorder is diagnosed using analysis of a sample from the subject (e.g., an aqueous cerebral spinal fluid (CSF) sample). In some embodiments, the sample is analyzed using a method selected from one or more of: fluorescent in situ hybridization (FISH), immunohistochemistry, SCN9A immunoassay, electron microscopy, laser microdissection, and mass spectrometry. In some embodiments, pain, e.g., chronic pain, or pain-related disorder is diagnosed using any suitable diagnostic test or technique, e.g., SCN9A mutation testing, a measure of pain sensitivity, a measure of pain threshold, a measure of pain level, and/or a measure of pain disability level (Dansie and Turk 2013 *Br J Anaesth* 111(1): 19-25).

Combination Therapies

In some embodiments, an iRNA (e.g., a dsRNA) disclosed herein is administered in combination with a second therapy (e.g., one or more additional therapies) known to be effective in treating a disorder related to SCN9A expression (e.g., pain, e.g., chronic pain or pain-related disorder) or a symptom of such a disorder. The iRNA may be administered before, after, or concurrent with the second therapy. In some embodiments, the iRNA is administered before the second therapy. In some embodiments, the iRNA is administered after the second therapy. In some embodiments, the iRNA is administered concurrent with the second therapy.

The second therapy may be an additional therapeutic agent. The iRNA and the additional therapeutic agent can be administered in combination in the same composition or the additional therapeutic agent can be administered as part of a separate composition.

In some embodiments, the second therapy is a non-iRNA therapeutic agent that is effective to treat the disorder or symptoms of the disorder.

In some embodiments, the iRNA is administered in conjunction with a therapy.

Exemplary combination therapies include, but are not limited to, non-steroidal anti-inflammatory drugs (NSAIDs), acetaminophen, opioids, or corticosteroids, acupuncture, therapeutic massage, dorsal root ganglion stimulation, spinal cord stimulation, or topical pain relievers.

Administration Dosages, Routes, and Timing

A subject (e.g., a human subject, e.g., a patient) can be administered a therapeutic amount of iRNA. The therapeutic amount can be, e.g., 0.05-50 mg/kg. For example, the therapeutic amount can be 0.05, 0.1, 0.2, 0.3, 0.4, 0.5, 0.6, 0.7, 0.8, 0.9, 1.0, 1.5, 2.0, or 2.5, 3.0, 3.5, 4.0, 4.5, 5, 10, 15, 20, 25, 30, 35, 40, 45, or 50 mg/kg dsRNA.

In some embodiments, the iRNA is formulated for delivery to a target organ, e.g., to the brain or spinal chord.

In some embodiments, the iRNA is formulated as a lipid formulation, e.g., an LNP formulation as described herein. In some such embodiments, the therapeutic amount is 0.05-5 mg/kg, e.g., 0.05, 0.1, 0.2, 0.3, 0.4, 0.5, 0.6, 0.7, 0.8, 0.9, 1.0, 1.5, 2.0, 2.5, 3.0, 3.5, 4.0, 4.5, or 5.0 mg/kg dsRNA. In some embodiments, the lipid formulation, e.g., LNP formulation, is administered intravenously. In some embodiments, the iRNA (e.g., dsRNA) is formulated as an LNP formulation and is administered (e.g., intravenously, intrathecally, intracerebrally, intracranially, or intraventricularly administered) at a dose of 0.1 to 1 mg/kg.

In some embodiments, the iRNA is administered by intravenous infusion over a period of time, such as over a 5 minute, 10 minute, 15 minute, 20 minute, or 25 minute period.

In some embodiments, the iRNA is in the form of a lipophilic conjugate (e.g., a C16 conjugate) as described herein. In some such embodiments, the therapeutic amount is 0.5-50 mg, e.g., 0.5, 0.6, 0.7, 0.8, 0.9, 1.0, 1.5, 2.0, 2.5, 3.0, 3.5, 4.0, 4.5, 5.0, 6, 7, 8, 9, 10, 15, 20, 25, 30, 35, 40, 45, or 50 mg/kg dsRNA. In some embodiments, the lipophilic conjugate (e.g., a C16 conjugate) is administered subcutaneously. In some embodiments, the iRNA (e.g., dsRNA) is in the form of a lipophilic conjugate and is administered (e.g., subcutaneously administered) at a dose of 1 to 10 mg/kg. In some embodiments, the iRNA is in the form of a GalNAc conjugate e.g., as described herein. In some such embodiments, the therapeutic amount is 0.5-50 mg, e.g., 0.5, 0.6, 0.7, 0.8, 0.9, 1.0, 1.5, 2.0, 2.5, 3.0, 3.5, 4.0, 4.5, 5.0, 6, 7, 8, 9, 10, 15, 20, 25, 30, 35, 40, 45, or 50 mg/kg dsRNA. In some embodiments, the e.g., GalNAc conjugate is administered subcutaneously.

In some embodiments, the administration is repeated, for example, on a regular basis, such as, daily, biweekly (i.e., every two weeks) for one month, two months, three months, four months, six months or longer. After an initial treatment regimen, the treatments can be administered on a less frequent basis. For example, after administration biweekly for three months, administration can be repeated once per month, for six months or a year or longer.

In some embodiments, the iRNA agent is administered in two or more doses. In some embodiments, the number or amount of subsequent doses is dependent on the achievement of a desired effect, e.g., to (a) reduce pain; (b) inhibit or reduce the expression or activity of SCN9A or the achievement of a therapeutic or prophylactic effect, e.g., reduction or prevention of one or more symptoms associated with the disorder.

In some embodiments, the iRNA agent is administered according to a schedule. For example, the iRNA agent may be administered once per week, twice per week, three times per week, four times per week, or five times per week. In some embodiments, the schedule involves regularly spaced administrations, e.g., hourly, every four hours, every six hours, every eight hours, every twelve hours, daily, every 2 days, every 3 days, every 4 days, every 5 days, weekly, biweekly, or monthly. In some embodiments, the iRNA agent is administered at the frequency required to achieve a desired effect.

In some embodiments, the schedule involves closely spaced administrations followed by a longer period of time during which the agent is not administered. For example, the schedule may involve an initial set of doses that are administered in a relatively short period of time (e.g., about every 6 hours, about every 12 hours, about every 24 hours, about every 48 hours, or about every 72 hours) followed by a longer time period (e.g., about 1 week, about 2 weeks, about 3 weeks, about 4 weeks, about 5 weeks, about 6 weeks, about 7 weeks, or about 8 weeks) during which the iRNA agent is not administered. In some embodiments, the iRNA agent is initially administered hourly and is later administered at a longer interval (e.g., daily, weekly, biweekly, or monthly). In some embodiments, the iRNA agent is initially administered daily and is later administered at a longer interval (e.g., weekly, biweekly, or monthly). In certain embodiments, the longer interval increases over time or is determined based on the achievement of a desired effect.

Before administration of a full dose of the iRNA, patients can be administered a smaller dose, such as a 5% infusion dose, and monitored for adverse effects, such as an allergic reaction, or for elevated lipid levels or blood pressure. In another example, the patient can be monitored for unwanted effects.

Methods for Modulating Expression of SCN9A

In some aspects, the disclosure provides a method for modulating (e.g., inhibiting or activating) the expression of SCN9A, e.g., in a cell, in a tissue, or in a subject. In some embodiments, the cell or tissue is ex vivo, in vitro, or in vivo. In some embodiments, the cell or tissue is in the central nervous system (e.g., brain or spine tissue, e.g., cortex, cerebellum, dorsal root ganglia, substantia nigra, cerebellar dentate nucleus, pallidum, striatum, brainstem, thalamus, subthalamic, red, and pontine nuclei, cranial nerve nuclei and the anterior horn; and Clarke's column of the spinal cord cervical spine, lumbar spine, or thoracic spine). In some embodiments, the cell or tissue is in a subject (e.g., a mammal, such as, for example, a human) In some embodiments, the subject (e.g., the human) is at risk, or is diagnosed with a disorder related to expression of SCN9A expression, as described herein.

In some embodiments, the method includes contacting the cell with an iRNA as described herein, in an amount effective to decrease the expression of SCN9A in the cell. In some embodiments, contacting a cell with an RNAi agent includes contacting a cell in vitro with the RNAi agent or contacting a cell in vivo with the RNAi agent. In some embodiments, the RNAi agent is put into physical contact with the cell by the individual performing the method, or the RNAi agent may be put into a situation that will permit or cause it to subsequently come into contact with the cell. Contacting a cell in vitro may be done, for example, by incubating the cell with the RNAi agent. Contacting a cell in vivo may be done, for example, by injecting the RNAi agent into or near the tissue where the cell is located, or by injecting the RNAi agent into another area, e.g., a CNS tissue. For example, the RNAi agent may contain or be coupled to a ligand, e.g., a lipophilic moiety or moieties as described below and further detailed, e.g., in PCT/US2019/031170 which is incorporated herein by reference in its entirety, including the passages therein describing lipophilic moieties, that directs or otherwise stabilizes the RNAi agent at a site of interest. Combinations of in vitro and in vivo methods of contacting are also possible. For example, a cell may also be contacted in vitro with an RNAi agent and subsequently transplanted into a subject.

The expression of SCN9A may be assessed based on the level of expression of SCN9A mRNA, SCN9A protein, or the level of another parameter functionally linked to the level of expression of SCN9A. In some embodiments, the expression of SCN9A is inhibited by at least 5%, at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90%, or at least 95%. In some embodiments, the iRNA has an $IC_{50}$ in the range of 0.001-0.01 nM, 0.001-0.10 nM, 0.001-1.0 nM, 0.001-10 nM, 0.01-0.05 nM, 0.01-0.50 nM, 0.02-0.60 nM, 0.01-1.0 nM, 0.01-1.5 nM, 0.01-10 nM. The $IC_{50}$ value may be normalized relative to an appropriate control value, e.g., the $IC_{50}$ of a non-targeting iRNA.

In some embodiments, the method includes introducing into the cell or tissue an iRNA as described herein and maintaining the cell or tissue for a time sufficient to obtain degradation of the mRNA transcript of SCN9A, thereby inhibiting the expression of SCN9A in the cell or tissue.

In some embodiments, the method includes administering a composition described herein, e.g., a composition comprising an iRNA that binds SCN9A, to the mammal such that expression of the target SCN9A is decreased, such as for an extended duration, e.g., at least two, three, four days or more, e.g., one week, two weeks, three weeks, or four weeks or longer. In some embodiments, the decrease in expression of SCN9A is detectable within 1 hour, 2 hours, 4 hours, 8 hours, 12 hours, or 24 hours of the first administration.

In some embodiments, the method includes administering a composition as described herein to a mammal such that expression of the target SCN9A is increased by e.g., at least 10% compared to an untreated animal. In some embodiments, the activation of SCN9A occurs over an extended duration, e.g., at least two, three, four days or more, e.g., one week, two weeks, three weeks, four weeks, or more. Without wishing to be bound by theory, an iRNA can activate SCN9A expression by stabilizing the SCN9A mRNA transcript, interacting with a promoter in the genome, or inhibiting an inhibitor of SCN9A expression.

The iRNAs useful for the methods and compositions featured in the disclosure specifically target RNAs (primary or processed) of SCN9A. Compositions and methods for inhibiting the expression of SCN9A using iRNAs can be prepared and performed as described elsewhere herein.

In some embodiments, the method includes administering a composition containing an iRNA, where the iRNA includes a nucleotide sequence that is complementary to at least a part of an RNA transcript of SCN9A of the subject, e.g., the mammal, e.g., the human, to be treated. The composition may be administered by any appropriate means known in the art including, but not limited to intracranial, intrathecal, intraventricular, topical, and intravenous administration.

In certain embodiments, the composition is administered, e.g., using oral, intraperitoneal, or parenteral routes, including intracranial (e.g., intraventricular, intraparenchymal, intracranial, and intrathecal), intravenous, intramuscular, intravitreal, subcutaneous, transdermal, airway (aerosol), nasal, or rectal. In other embodiments, the composition is administered topically (e.g., buccal and sublingual administration). In other embodiments, the composition is administered by intravenous infusion or injection. In certain embodiments, the compositions are administered by intrathecal injection. In certain embodiments, the compositions are administered by intraventricular injection. In certain embodiments, the compositions are administered by intracranial injection. In certain embodiments, the compositions are administered by epidural injection. In certain embodiments, the compositions are administered by intraganglionic injection.

In certain embodiments, the composition is administered by intravenous infusion or injection. In some such embodiments, the composition comprises a lipid formulated siRNA (e.g., an LNP formulation, such as an LNP11 formulation) for intravenous infusion.

Unless otherwise defined, all technical and scientific terms used herein have the same meaning as commonly understood by one of ordinary skill in the art to which this disclosure belongs. Although methods and materials similar or equivalent to those described herein can be used in the practice or testing of the iRNAs and methods featured in the disclosure, suitable methods and materials are described below. All publications, patent applications, patents, and other references mentioned herein are incorporated by reference in their entirety. In case of conflict, the present specification, including definitions, will control. In addition, the materials, methods, and examples are illustrative only and not intended to be limiting.

SPECIFIC EMBODIMENTS

1. A double stranded ribonucleic acid (dsRNA) agent for inhibiting expression sodium channel, voltage gated, type IX alpha subunit (SCN9A), wherein the dsRNA agent comprises a sense strand and an antisense strand forming a double stranded region, wherein the sense strand comprises a nucleotide sequence comprising at least 15 contiguous nucleotides, with 0, 1, 2, or 3 mismatches, of a portion of a coding strand of human SCN9A and the antisense strand comprises a nucleotide sequence comprising at least 15 contiguous nucleotides, with 0, 1, 2, or 3 mismatches, of the corresponding portion of a non-coding strand of human SCN9A such that the sense strand is complementary to the at least 15 contiguous nucleotides in the antisense strand.
2. The dsRNA agent of embodiment 1, wherein the coding strand of human SCN9A comprises the sequence SEQ ID NO: 1.
3. The dsRNA agent of embodiment 1 or 2, wherein the non-coding strand of human SCN9A comprises the sequence of SEQ ID NO: 2.
4 The dsRNA agent of embodiment 1, wherein the coding strand of human SCN9A comprises the sequence SEQ ID NO: 4001.
5. The dsRNA agent of embodiment 1 or 4, wherein the non-coding strand of human SCN9A comprises the sequence of SEQ ID NO: 4002.
6. A double stranded ribonucleic acid (dsRNA) agent for inhibiting expression of SCN9A, wherein the dsRNA agent comprises a sense strand and an antisense strand forming a double stranded region, wherein the antisense strand comprises a nucleotide sequence comprising at least 15 contiguous nucleotides, with 0, 1, 2, or 3 mismatches, of a portion of nucleotide sequence of SEQ ID NO: 2 such that the sense strand is complementary to the at least 15 contiguous nucleotides in the antisense strand.
7. The dsRNA agent of embodiment 6, wherein the sense strand comprises a nucleotide sequence comprising at least 15 contiguous nucleotides, with 0, or 1, 2, or 3 mismatches, of the corresponding portion of the nucleotide sequence of SEQ ID NO: 1.
8. A double stranded ribonucleic acid (dsRNA) agent for inhibiting expression of SCN9A, wherein the dsRNA agent comprises a sense strand and an antisense strand forming a double stranded region, wherein the antisense strand comprises a nucleotide sequence comprising at least 15 contiguous nucleotides, with 0, 1, 2, or 3 mismatches, of a portion of nucleotide sequence of SEQ ID NO: 4002 such that the sense strand is complementary to the at least 15 contiguous nucleotides in the antisense strand.
9. The dsRNA agent of embodiment 8, wherein the sense strand comprises a nucleotide sequence comprising at least 15 contiguous nucleotides, with 0, or 1, 2, or 3 mismatches, of the corresponding portion of the nucleotide sequence of SEQ ID NO: 4001.
10. The dsRNA of any of the preceding embodiments, wherein the dsRNA agent comprises a sense strand and an antisense strand, wherein the antisense strand comprises a nucleotide sequence comprising at least 17 contiguous nucleotides, with 0, 1, 2, or 3 mismatches, of a portion of nucleotide sequence of SEQ ID NO: 2 such that the sense strand is complementary to the at least 17 contiguous nucleotides in the antisense strand.

11. The dsRNA of embodiment 10, wherein the sense strand comprises a nucleotide sequence comprising at least 17 contiguous nucleotides, with 0, or 1, 2, or 3 mismatches, of the corresponding portion of the nucleotide sequence of SEQ ID NO: 1.

12. The dsRNA of any of the preceding embodiments, wherein the dsRNA agent comprises a sense strand and an antisense strand, wherein the antisense strand comprises a nucleotide sequence comprising at least 17 contiguous nucleotides, with 0, 1, 2, or 3 mismatches, of a portion of nucleotide sequence of SEQ ID NO: 4002 such that the sense strand is complementary to the at least 17 contiguous nucleotides in the antisense strand.

13. The dsRNA of embodiment 12, wherein the sense strand comprises a nucleotide sequence comprising at least 17 contiguous nucleotides, with 0, or 1, 2, or 3 mismatches, of the corresponding portion of the nucleotide sequence of SEQ ID NO: 4001.

14. The dsRNA of any of the preceding embodiments, wherein the dsRNA agent comprises a sense strand and an antisense strand, wherein the antisense strand comprises a nucleotide sequence comprising at least 19 contiguous nucleotides, with 0, 1, 2, or 3 mismatches, of a portion of nucleotide sequence of SEQ ID NO: 2 such that the sense strand is complementary to the at least 19 contiguous nucleotides in the antisense strand.

15. The dsRNA of embodiment 14, wherein the sense strand comprises a nucleotide sequence comprising at least 19 contiguous nucleotides, with 0, 1, 2, or 3 mismatches, of the corresponding portion of the nucleotide sequence of SEQ ID NO: 1.

16. The dsRNA of any of the preceding embodiments, wherein the dsRNA agent comprises a sense strand and an antisense strand, wherein the antisense strand comprises a nucleotide sequence comprising at least 19 contiguous nucleotides, with 0, 1, 2, or 3 mismatches, of a portion of nucleotide sequence of SEQ ID NO: 4002 such that the sense strand is complementary to the at least 19 contiguous nucleotides in the antisense strand.

17. The dsRNA of embodiment 16, wherein the sense strand comprises a nucleotide sequence comprising at least 19 contiguous nucleotides, with 0, 1, 2, or 3 mismatches, of the corresponding portion of the nucleotide sequence of SEQ ID NO: 4001.

18. The dsRNA of any of the preceding embodiments, wherein the dsRNA agent comprises a sense strand and an antisense strand, wherein the antisense strand comprises a nucleotide sequence comprising at least 21 contiguous nucleotides, with 0, 1, 2, or 3 mismatches, of a portion of nucleotide sequence of SEQ ID NO: 2 such that the sense strand is complementary to the at least 21 contiguous nucleotides in the antisense strand.

19. The dsRNA of embodiment 18, wherein the sense strand comprises a nucleotide sequence comprising at least 21 contiguous nucleotides, with 0, or 1, 2, or 3 mismatches, of the corresponding portion of the nucleotide sequence of SEQ ID NO: 1.

20. The dsRNA of any of the preceding embodiments, wherein the dsRNA agent comprises a sense strand and an antisense strand, wherein the antisense strand comprises a nucleotide sequence comprising at least 21 contiguous nucleotides, with 0, 1, 2, or 3 mismatches, of a portion of nucleotide sequence of SEQ ID NO: 4002 such that the sense strand is complementary to the at least 21 contiguous nucleotides in the antisense strand.

21. The dsRNA of embodiment 20, wherein the sense strand comprises a nucleotide sequence comprising at least 21 contiguous nucleotides, with 0, or 1, 2, or 3 mismatches, of the corresponding portion of the nucleotide sequence of SEQ ID NO: 4001.

22. The dsRNA agent of any one of embodiments 1-21, wherein the portion of the sense strand is a portion within nucleotides 581-601, 760-780, or 8498-8518 of SEQ ID NO: 4001.

23. The dsRNA agent of any one of embodiments 1-22, wherein the portion of the sense strand is a portion within a sense strand from a duplex chosen from AD-1251284 (UGUCGAGUACACUUUUACUGA (SEQ ID NO:4827)), AD-961334 (CAACACAA-TUTCUUCUUAGCA (SEQ ID NO: 5026)), or AD-1251325 (AAAACAAUCUUCCGUUUCAAA (SEQ ID NO: 4822)).

24. The dsRNA agent of any one of embodiments 1-23, wherein the portion of the sense strand is a sense strand chosen from the sense strands of AD-1251284 (UGU-CGAGUACACUUUUACUGA (SEQ ID NO:4827)), AD-961334 (CAACACAATUTCUUCUUAGCA (SEQ ID NO: 5026)), or AD-1251325 (AAAACAAUCUUCCGUUUCAAA (SEQ ID NO: 4822)).

25. The dsRNA of any one of embodiments 1-24, wherein the portion of the antisense strand is a portion within an antisense strand from a duplex chosen from AD-1251284 (UCAGTAAAAGUGUACTCGACAUU (SEQ ID NO: 5093)), AD-961334 (UGC-UAAGAAGAAATUGUGUUGUU (SEQ ID NO: 5292)), or AD-1251325 (UUUGAAACGGAAGAUU-GUUUUCC (SEQ ID NO: 5088)).

26. The dsRNA of any one of embodiments 1-25, wherein the portion of the antisense strand is an antisense strand chosen the antisense strands of AD-1251284 (UCAGTAAAAGUGUACTCGACAUU (SEQ ID NO: 5093)), AD-961334 (UGCUAAGAAGAAATU-GUGUUGUU (SEQ ID NO: 5292)), or AD-1251325 (UUUGAAACGGAAGAUUGUUUUCC (SEQ ID NO: 5088)).

27. The dsRNA of any one of embodiments 1-26, wherein the sense strand and the antisense strand comprise nucleotide sequences of the paired sense strand and antisense strand of a duplex selected from AD-1251284 (SEQ ID NO: 4827 and 5093), AD-961334 (SEQ ID NO: 5026 and 5292), or AD-1251325 (SEQ ID NO: 4822 and 5088).

28. The dsRNA agent of any one of the preceding embodiments, wherein the portion of the sense strand is a portion within a sense strand in any one of Tables 2A, 2B, 4A, 4B, 5A, 5B, 6A, 6B, 13A, 13B, 14A, 14B, 15A, 15B, 16, 18, and 20.

29. The dsRNA agent of any one of the preceding embodiments, wherein the portion of the antisense strand is a portion within an antisense strand in any one of Tables 2A, 2B, 4A, 4B, 5A, 5B, 6A, 6B, 13A, 13B, 14A, 14B, 15A, 15B, 16, 18, and 20.

30. The dsRNA agent of any of the preceding embodiments, wherein the antisense strand comprises a nucleotide sequence comprising at least 15 contiguous nucleotides, with 0, 1, 2, or 3 mismatches, from one of the antisense sequences listed in any one of Tables 2A, 2B, 4A, 4B, 5A, 5B, 6A, 6B, 13A, 13B, 14A, 14B, 15A, 15B, 16, 18, and 20.

31. The dsRNA agent of any of the preceding embodiments, wherein the sense strand comprises a nucleotide sequence comprising at least 15 contiguous nucleotides, with 0, 1, 2, or 3 mismatches, from a sense sequence listed in any one of Tables 2A, 2B, 4A, 4B, 5A, 5B, 6A, 6B, 13A, 13B, 14A, 14B, 15A, 15B, 16, 18, and 20 that corresponds to the antisense sequence.

32. The dsRNA agent of any of the preceding embodiments, wherein the antisense strand comprises a nucleotide sequence comprising at least 17 contiguous nucleotides, with 0, 1, 2, or 3 mismatches, from one of the antisense sequences listed in any one of Tables 2A, 2B, 4A, 4B, 5A, 5B, 6A, 6B, 13A, 13B, 14A, 14B, 15A, 15B, 16, 18, and 20.

33. The dsRNA agent of any of the preceding embodiments, wherein the sense strand comprises a nucleotide sequence comprising at least 17 contiguous nucleotides, with 0, 1, 2, or 3 mismatches, from a sense sequence listed in any one of Tables 2A, 2B, 4A, 4B, 5A, 5B, 6A, 6B, 13A, 13B, 14A, 14B, 15A, 15B, 16, 18, and 20 that corresponds to the antisense sequence.

34. The dsRNA agent of any of the preceding embodiments, wherein the antisense strand comprises a nucleotide sequence comprising at least 19 contiguous nucleotides, with 0,1, 2, or 3 mismatches, from one of the antisense sequences listed in any one of Tables 2A, 2B, 4A, 4B, 5A, 5B, 6A, 6B, 13A, 13B, 14A, 14B, 15A, 15B, 16, 18, and 20.

35. The dsRNA agent of any of the preceding embodiments, wherein the sense strand comprises a nucleotide sequence comprising at least 19 contiguous nucleotides, with 0, 1, 2, or 3 mismatches, from a sense sequence listed in any one of Tables 2A, 2B, 4A, 4B, 5A, 5B, 6A, 6B, 13A, 13B, 14A, 14B, 15A, 15B, 16, 18, and 20 that corresponds to the antisense sequence.

36. The dsRNA agent of any of the preceding embodiments, wherein the antisense strand comprises a nucleotide sequence comprising at least 21 contiguous nucleotides, with 0,1, 2, or 3 mismatches, from one of the antisense sequences listed in any one of Tables 2A, 2B, 4A, 4B, 5A, 5B, 6A, 6B, 13A, 13B, 14A, 14B, 15A, 15B, 16, 18, and 20.

37. The dsRNA agent of any of the preceding embodiments, wherein the sense strand comprises a nucleotide sequence comprising at least 21 contiguous nucleotides, with 0, 1, 2, or 3 mismatches, from a sense sequence listed in any one of Tables 2A, 2B, 4A, 4B, 5A, 5B, 6A, 6B, 13A, 13B, 14A, 14B, 15A, 15B, 16, 18, and 20 that corresponds to the antisense sequence.

38. A double-stranded ribonucleic acid (dsRNA) agent for inhibiting expression of SCN9A, wherein the dsRNA agent comprises a sense strand and an antisense strand forming a double-stranded region, wherein the antisense strand comprises a nucleotide sequence of an antisense sequence listed in any one of Tables 2A, 2B, 4A, 4B, 5A, 5B, 6A, 6B, 13A, 13B, 14A, 14B, 15A, 15B, 16, 18, and 20, and the sense strand comprises a nucleotide sequence of a sense sequence listed in any one of Tables 2A, 2B, 4A, 4B, 5A, 5B, 6A, 6B, 13A, 13B, 14A, 14B, 15A, 15B, 16, 18, and 20 that corresponds to the antisense sequence.

39. The dsRNA agent of embodiment 38, wherein the antisense strand comprises a nucleotide sequence of an antisense sequence listed in Table 5A, and the sense strand comprises a nucleotide sequence of a sense sequence listed in Table 5A that corresponds to the antisense sequence.

40. The dsRNA agent of embodiment 38, wherein the antisense strand comprises a nucleotide sequence of an antisense sequence listed in Table 13A, and the sense strand comprises a nucleotide sequence of a sense sequence listed in Table 13A that corresponds to the antisense sequence.

41. The dsRNA agent of embodiment 38, wherein the antisense strand comprises a nucleotide sequence of an antisense sequence listed in Table 14A, and the sense strand comprises a nucleotide sequence of a sense sequence listed in Table 14A that corresponds to the antisense sequence.

42. The dsRNA agent of embodiment 38, wherein the antisense strand comprises a nucleotide sequence of an antisense sequence listed in Table 15A, and the sense strand comprises a nucleotide sequence of a sense sequence listed in Table 15A that corresponds to the antisense sequence.

43. The dsRNA agent of embodiment 38, wherein the antisense strand comprises a nucleotide sequence of an antisense sequence listed in Table 16, and the sense strand comprises a nucleotide sequence of a sense sequence listed in Table 16 that corresponds to the antisense sequence.

44. The dsRNA agent of any one of embodiments 38, wherein the dsRNA agent is AD-1251284, AD-961334, AD-1251325, AD-1331352, AD-1209344, or AD-1331350.

45. The dsRNA of any one of embodiments 38-44, wherein:

(i) the sense strand comprises the sequence and all the modifications of SEQ ID NO: 4029, and the antisense strand comprises the sequence and all the modifications of SEQ ID NO: 4295;

(ii) the sense strand comprises the sequence and all the modifications of SEQ ID NO: 4228, and the antisense strand comprises the sequence and all the modifications of SEQ ID NO: 4494;

(iii) the sense strand comprises the sequence and all the modifications of SEQ ID NO: 5339, and the antisense strand comprises the sequence and all the modifications of SEQ ID NO: 5355;

(iv) the sense strand comprises the sequence and all the modifications of SEQ ID NO: 5800, and the antisense strand comprises the sequence and all the modifications of SEQ ID NO: 5801;

(v) the sense strand comprises the sequence and all the modifications of SEQ ID NO: 5526, and the antisense strand comprises the sequence and all the modifications of SEQ ID NO: 5681; or (vi) the sense strand comprises the sequence and all the modifications of SEQ ID NO: 5542, and the antisense strand comprises the sequence and all the modifications of SEQ ID NO: 5697.

46. The dsRNA agent of any of the preceding embodiments, wherein the sense strand is at least 23 nucleotides in length, e.g., 23-30 nucleotides in length.

47. The dsRNA agent of any of the preceding embodiments, wherein at least one of the sense strand and the antisense strand is conjugated to one or more lipophilic moieties.

48. The dsRNA agent of embodiment 47, wherein the lipophilic moiety is conjugated to one or more positions in the double stranded region of the dsRNA agent.

49. The dsRNA agent of embodiment 47 or 48, wherein the lipophilic moiety is conjugated via a linker or carrier.
50. The dsRNA agent of any one of embodiments 47-49, wherein lipophilicity of the lipophilic moiety, measured by log Kow, exceeds 0.
51. The dsRNA agent of any one of the preceding embodiments, wherein the hydrophobicity of the double-stranded RNAi agent, measured by the unbound fraction in a plasma protein binding assay of the double-stranded RNAi agent, exceeds 0.2.
52. The dsRNA agent of embodiment 51, wherein the plasma protein binding assay is an electrophoretic mobility shift assay using human serum albumin protein.
53. The dsRNA agent of any of the preceding embodiments, wherein the dsRNA agent comprises at least one modified nucleotide.
54. The dsRNA agent of embodiment 53, wherein no more than five of the sense strand nucleotides and not more than five of the nucleotides of the antisense strand are unmodified nucleotides.
55. The dsRNA agent of embodiment 53, wherein all of the nucleotides of the sense strand and all of the nucleotides of the antisense strand comprise a modification.
56. The dsRNA agent of any one of embodiments 53-55, wherein at least one of the modified nucleotides is selected from the group consisting of a deoxy-nucleotide, a 3'-terminal deoxythimidine (dT) nucleotide, a 2'-O-methyl modified nucleotide, a 2'-fluoro modified nucleotide, a 2'-deoxy-modified nucleotide, a locked nucleotide, an unlocked nucleotide, a conformationally restricted nucleotide, a constrained ethyl nucleotide, an abasic nucleotide, a 2'-amino-modified nucleotide, a 2'-O-allyl-modified nucleotide, 2'-C-alkyl-modified nucleotide, a 2'-methoxyethyl modified nucleotide, a 2'-O-alkyl-modified nucleotide, a morpholino nucleotide, a phosphoramidate, a non-natural base comprising nucleotide, a tetrahydropyran modified nucleotide, a 1,5-anhydrohexitol modified nucleotide, a cyclohexenyl modified nucleotide, a nucleotide comprising a phosphorothioate group, a nucleotide comprising a methylphosphonate group, a nucleotide comprising a 5'-phosphate, a nucleotide comprising a 5'-phosphate mimic, a glycol modified nucleotide, and a 2-O-(N-methylacetamide) modified nucleotide; and combinations thereof.
57. The dsRNA agent of any of embodiments 53-42, wherein no more than five of the sense strand nucleotides and not more than five of the nucleotides of the antisense strand include modifications other than 2'-O-methyl modified nucleotide, a 2'-fluoro modified nucleotide, a 2'-deoxy-modified nucleotide, unlocked nucleic acids (UNA) or glycerol nucleic acid (GNA).
58. The dsRNA agent of any of the preceding embodiments, which comprises a non-nucleotide spacer (wherein optionally the non-nucleotide spacer comprises a C3-C6 alkyl) between two of the contiguous nucleotides of the sense strand or between two of the contiguous nucleotides of the antisense strand.
59. The dsRNA agent of any of the preceding embodiments, wherein each strand is no more than 30 nucleotides in length.
60. The dsRNA agent of any of the preceding embodiments, wherein at least one strand comprises a 3' overhang of at least 1 nucleotide.
61. The dsRNA agent of any of the preceding embodiments, wherein at least one strand comprises a 3' overhang of at least 2 nucleotides.
62. The dsRNA agent of any of the preceding embodiments, wherein the double stranded region is 15-30 nucleotide pairs in length.
63. The dsRNA agent of embodiment 62, wherein the double stranded region is 17-23 nucleotide pairs in length.
64. The dsRNA agent of embodiment 62, wherein the double stranded region is 17-25 nucleotide pairs in length.
65. The dsRNA agent of embodiment 62, wherein the double stranded region is 23-27 nucleotide pairs in length.
66. The dsRNA agent of embodiment 62, wherein the double stranded region is 19-21 nucleotide pairs in length.
67. The dsRNA agent of embodiment 62, wherein the double stranded region is 21-23 nucleotide pairs in length.
68. The dsRNA agent of any of the preceding embodiments, wherein each strand has 19-30 nucleotides.
69. The dsRNA agent of any of the preceding embodiments, wherein each strand has 19-23 nucleotides.
70. The dsRNA agent of any of the preceding embodiments, wherein each strand has 21-23 nucleotides.
71. The dsRNA agent of any of the preceding embodiments, wherein the agent comprises at least one phosphorothioate or methylphosphonate internucleotide linkage.
72. The dsRNA agent of embodiment 71, wherein the phosphorothioate or methylphosphonate internucleotide linkage is at the 3'-terminus of one strand.
73. The dsRNA agent of embodiment 72, wherein the strand is the antisense strand.
74. The dsRNA agent of embodiment 72, wherein the strand is the sense strand.
75. The dsRNA agent of embodiment 71, wherein the phosphorothioate or methylphosphonate internucleotide linkage is at the 5'-terminus of one strand.
76. The dsRNA agent of embodiment 75, wherein the strand is the antisense strand.
77. The dsRNA agent of embodiment 75, wherein the strand is the sense strand.
78. The dsRNA agent of embodiment 71, wherein each of the 5'- and 3'-terminus of one strand comprises a phosphorothioate or methylphosphonate internucleotide linkage.
79. The dsRNA agent of embodiment 78, wherein the strand is the antisense strand.
80. The dsRNA agent of any of the preceding embodiments, wherein the base pair at the 1 position of the 5'-end of the antisense strand of the duplex is an AU base pair.
81. The dsRNA agent of embodiment 78, wherein the sense strand has a total of 21 nucleotides and the antisense strand has a total of 23 nucleotides.
82. The dsRNA agent of any one of embodiments 47-81, wherein one or more lipophilic moieties are conjugated to one or more internal positions on at least one strand.
83. The dsRNA agent of embodiment 82, wherein the one or more lipophilic moieties are conjugated to one or more internal positions on at least one strand via a linker or carrier.

84. The dsRNA agent of embodiment 83, wherein the internal positions include all positions except the terminal two positions from each end of the at least one strand.
85. The dsRNA agent of embodiment 83, wherein the internal positions include all positions except the terminal three positions from each end of the at least one strand.
86. The dsRNA agent of any one of embodiments 83-85, wherein the internal positions exclude a cleavage site region of the sense strand.
87. The dsRNA agent of embodiment 86, wherein the internal positions include all positions except positions 9-12, counting from the 5'-end of the sense strand.
88. The dsRNA agent of embodiment 86, wherein the internal positions include all positions except positions 11-13, counting from the 3'-end of the sense strand.
89. The dsRNA agent of any one of embodiments 83-85, wherein the internal positions exclude a cleavage site region of the antisense strand.
90. The dsRNA agent of embodiment 89, wherein the internal positions include all positions except positions 12-14, counting from the 5'-end of the antisense strand.
91. The dsRNA agent of any one of embodiments 83-85, wherein the internal positions include all positions except positions 11-13 on the sense strand, counting from the 3'-end, and positions 12-14 on the antisense strand, counting from the 5'-end.
92. The dsRNA agent of any one of embodiments 47-91, wherein the one or more lipophilic moieties are conjugated to one or more of the internal positions selected from the group consisting of positions 4-8 and 13-18 on the sense strand, and positions 6-10 and 15-18 on the antisense strand, counting from the 5' end of each strand.
93. The dsRNA agent of embodiment 92, wherein the one or more lipophilic moieties are conjugated to one or more of the internal positions selected from the group consisting of positions 5, 6, 7, 15, and 17 on the sense strand, and positions 15 and 17 on the antisense strand, counting from the 5'-end of each strand.
94. The dsRNA agent of embodiment 48, wherein the positions in the double stranded region exclude a cleavage site region of the sense strand.
95. The dsRNA agent of any one of embodiments 47-80, wherein the sense strand is 21 nucleotides in length, the antisense strand is 23 nucleotides in length, and the lipophilic moiety is conjugated to position 21, position 20, position 15, position 1, position 7, position 6, or position 2 of the sense strand or position 16 of the antisense strand.
96. The dsRNA agent of embodiment 95, wherein the lipophilic moiety is conjugated to position 21, position 20, position 15, position 1, or position 7 of the sense strand.
97. The dsRNA agent of embodiment 95, wherein the lipophilic moiety is conjugated to position 21, position 20, or position 15 of the sense strand.
98. The dsRNA agent of embodiment 95, wherein the lipophilic moiety is conjugated to position 20 or position 15 of the sense strand.
99. The dsRNA agent of embodiment 95, wherein the lipophilic moiety is conjugated to position 16 of the antisense strand.
100. The dsRNA agent of embodiment 95, wherein the lipophilic moiety is conjugated to position 6, counting from the 5'-end of the sense strand.
101. The dsRNA agent of any one of embodiments 47-100, wherein the lipophilic moiety is an aliphatic, alicyclic, or polyalicyclic compound.
102. The dsRNA agent of embodiment 101, wherein the lipophilic moiety is selected from the group consisting of lipid, cholesterol, retinoic acid, cholic acid, adamantane acetic acid, 1-pyrene butyric acid, dihydrotestosterone, 1,3-bis-O(hexadecyl)glycerol, geranyloxyhexyanol, hexadecylglycerol, borneol, menthol, 1,3-propanediol, heptadecyl group, palmitic acid, myristic acid, O3-(oleoyl)lithocholic acid, O3-(oleoyl)cholenic acid, dimethoxytrityl, or phenoxazine.
103. The dsRNA agent of embodiment 102, wherein the lipophilic moiety contains a saturated or unsaturated C4-C30 hydrocarbon chain, and an optional functional group selected from the group consisting of hydroxyl, amine, carboxylic acid, sulfonate, phosphate, thiol, azide, and alkyne.
104. The dsRNA agent of embodiment 103, wherein the lipophilic moiety contains a saturated or unsaturated C6-C18 hydrocarbon chain.
105. The dsRNA agent of embodiment 103, wherein the lipophilic moiety contains a saturated or unsaturated C16 hydrocarbon chain.
106. The dsRNA agent of any one of embodiments 47-105, wherein the lipophilic moiety is conjugated via a carrier that replaces one or more nucleotide(s) in the internal position(s) or the double stranded region.
107. The dsRNA agent of embodiment 106, wherein the carrier is a cyclic group selected from the group consisting of pyrrolidinyl, pyrazolinyl, pyrazolidinyl, imidazolinyl, imidazolidinyl, piperidinyl, piperazinyl, [1,3]dioxolanyl, oxazolidinyl, isoxazolidinyl, morpholinyl, thiazolidinyl, isothiazolidinyl, quinoxalinyl, pyridazinonyl, tetrahydrofuranyl, and decalinyl; or is an acyclic moiety based on a serinol backbone or a diethanolamine backbone.
108. The dsRNA agent of any one of embodiments 47-105, wherein the lipophilic moiety is conjugated to the double-stranded iRNA agent via a linker containing an ether, thioether, urea, carbonate, amine, amide, maleimide-thioether, disulfide, phosphodiester, sulfonamide linkage, a product of a click reaction, or carbamate.
109. The double-stranded iRNA agent of any one of embodiments 47-108, wherein the lipophilic moiety is conjugated to a nucleobase, sugar moiety, or internucleosidic linkage.
110. The dsRNA agent of any one of embodiments 47-109, wherein the lipophilic moiety or targeting ligand is conjugated via a bio-cleavable linker selected from the group consisting of DNA, RNA, disulfide, amide, functionalized monosaccharides or oligosaccharides of galactosamine, glucosamine, glucose, galactose, mannose, and combinations thereof.
111. The dsRNA agent of any one of embodiments 47-110, wherein the 3' end of the sense strand is protected via an end cap which is a cyclic group having an amine, said cyclic group being selected from the group consisting of pyrrolidinyl, pyrazolinyl, pyrazolidinyl, imidazolinyl, imidazolidinyl, piperidinyl, piperazinyl, [1,3]dioxolanyl, oxazolidinyl, isoxazolidinyl, morpholinyl, thiazolidinyl, isothiazolidinyl, quinoxalinyl, pyridazinonyl, tetrahydrofuranyl, and decalinyl.
112. The dsRNA agent of any one of embodiments 47-111, further comprising a targeting ligand, e.g., a ligand that targets a CNS tissue or a liver tissue.

113. The dsRNA agent of embodiment 112, wherein the CNS tissue is a brain tissue or a spinal tissue.

114. The dsRNA agent of embodiment 112, wherein the targeting ligand is a GalNAc conjugate.

115. The dsRNA agent of any one of embodiments 1-114, further comprising a terminal, chiral modification occurring at the first internucleotide linkage at the 3' end of the antisense strand, having the linkage phosphorus atom in Sp configuration, a terminal, chiral modification occurring at the first internucleotide linkage at the 5' end of the antisense strand, having the linkage phosphorus atom in Rp configuration, and a terminal, chiral modification occurring at the first internucleotide linkage at the 5' end of the sense strand, having the linkage phosphorus atom in either Rp configuration or Sp configuration.

116. The dsRNA agent of any one of embodiments 1-114, further comprising a terminal, chiral modification occurring at the first and second internucleotide linkages at the 3' end of the antisense strand, having the linkage phosphorus atom in Sp configuration, a terminal, chiral modification occurring at the first internucleotide linkage at the 5' end of the antisense strand, having the linkage phosphorus atom in Rp configuration, and a terminal, chiral modification occurring at the first internucleotide linkage at the 5' end of the sense strand, having the linkage phosphorus atom in either Rp or Sp configuration.

117. The dsRNA agent of any one of embodiments 1-114, further comprising a terminal, chiral modification occurring at the first, second and third internucleotide linkages at the 3' end of the antisense strand, having the linkage phosphorus atom in Sp configuration, a terminal, chiral modification occurring at the first internucleotide linkage at the 5' end of the antisense strand, having the linkage phosphorus atom in Rp configuration, and a terminal, chiral modification occurring at the first internucleotide linkage at the 5' end of the sense strand, having the linkage phosphorus atom in either Rp or Sp configuration.

118. The dsRNA agent of any one of embodiments 1-114, further comprising a terminal, chiral modification occurring at the first, and second internucleotide linkages at the 3' end of the antisense strand, having the linkage phosphorus atom in Sp configuration, a terminal, chiral modification occurring at the third internucleotide linkages at the 3' end of the antisense strand, having the linkage phosphorus atom in Rp configuration, a terminal, chiral modification occurring at the first internucleotide linkage at the 5' end of the antisense strand, having the linkage phosphorus atom in Rp configuration, and a terminal, chiral modification occurring at the first internucleotide linkage at the 5' end of the sense strand, having the linkage phosphorus atom in either Rp or Sp configuration.

119. The dsRNA agent of any one of embodiments 1-114, further comprising a terminal, chiral modification occurring at the first, and second internucleotide linkages at the 3' end of the antisense strand, having the linkage phosphorus atom in Sp configuration, a terminal, chiral modification occurring at the first, and second internucleotide linkages at the 5' end of the antisense strand, having the linkage phosphorus atom in Rp configuration, and a terminal, chiral modification occurring at the first internucleotide linkage at the 5' end of the sense strand, having the linkage phosphorus atom in either Rp or Sp configuration.

120. The dsRNA agent of any one of embodiments 1-119, further comprising a phosphate or phosphate mimic at the 5'-end of the antisense strand.

121. The dsRNA agent of embodiment 120, wherein the phosphate mimic is a 5'-vinyl phosphonate (VP).

122. A cell containing the dsRNA agent of any one of embodiments 1-121.

123. A human peripheral sensory neuron, e.g., (a peripheral sensory neuron in a dorsal root ganglion, or a nociceptive neuron, e.g., an A-delta fiber or a C-type fiber) comprising a reduced level of SCN9A mRNA or a level of SCN9A protein as compared to an otherwise similar untreated peripheral sensory neuron, wherein optionally the level is reduced by at least 10%, 15%, 20%, 25%, 30%, 35%, 40%, 45%, 50%, 55%, 60%, 65%, 70%, 75%, 80%, 85%, 90%, or 95%.

124. The human peripheral sensory neuron of embodiment 123, which was produced by a process comprising contacting a peripheral sensory neuron with the dsRNA agent of any one of embodiments 1-121.

125. A pharmaceutical composition for inhibiting expression of SCN9A, comprising the dsRNA agent of any one of embodiments 1-121.

126. A pharmaceutical composition comprising the dsRNA agent of any one of embodiments 1-121 and a lipid formulation.

127. A method of inhibiting expression of SCN9A in a cell, the method comprising:

(a) contacting the cell with the dsRNA agent of any one of embodiments 1-121, or a pharmaceutical composition of embodiment 125 or 126; and (b) maintaining the cell produced in step (a) for a time sufficient to obtain degradation of the mRNA transcript of SCN9A thereby inhibiting expression of SCN9A in the cell.

128. A method of inhibiting expression of SCN9A in a cell, the method comprising:

(a) contacting the cell with the dsRNA agent of any one of embodiments 1-121, or a pharmaceutical composition of embodiment 125 or 126; and (b) maintaining the cell produced in step (a) for a time sufficient to reduce levels of SCN9A mRNA, SCN9A protein, or both of SCN9A mRNA and protein, thereby inhibiting expression of SCN9A in the cell.

129. The method of embodiment 127 or 128, wherein the cell is within a subject.

130. The method of embodiment 129, wherein the subject is a human.

131. The method of any one of embodiments 127-130, wherein the level of SCN9A mRNA is inhibited by at least 50%.

132. The method of any one of embodiments 127-130, wherein the level of SCN9A protein is inhibited by at least 50%.

133. The method of embodiment 130-132, wherein inhibiting expression of SCN9A decreases a SCN9A protein level in a biological sample (e.g., a a cerebral spinal fluid (CSF) sample, or a CNS biopsy sample) from the subject by at least 30%, 40%, 50%, 60%, 70%, 80%, 90%, or 95%.

134. The method of any one of embodiments 130-133, wherein the subject has been diagnosed with a SCN9A-associated disorder, e.g., pain, e.g., chronic pain e.g., inflammatory pain, neuropathic pain, pain hypersensitivity, pain hyposensitivity, inability to sense pain, primary erythromelalgia (PE), paroxysmal extreme pain disorder (PEPD), small fiber neuropathy (SFN), trigeminal neuralgia (TN), and pain associated with, e.g., cancer, arthritis, diabetes, traumatic injury and viral infections.

135. A method of inhibiting expression of SCN9A in an neuronal cell or tissue, the method comprising:

(a) contacting the cell or tissue with a dsRNA agent that binds SCN9A; and (b) maintaining the cell or tissue produced in step (a) for a time sufficient to reduce levels of SCN9A mRNA, SCN9A protein, or both of SCN9A mRNA and protein, thereby inhibiting expression of SCN9A in the cell or tissue.

136. The method of embodiment 135, wherein the neuronal cell or tissue comprises a peripheral sensory neuron, e.g., a peripheral sensory neuron in a dorsal root ganglion, or a nociceptive neuron, e.g., an A-delta fiber or a C-type fiber.

137. A method of treating a subject having or diagnosed with having a SCN9A-associated disorder comprising administering to the subject a therapeutically effective amount of the dsRNA agent of any one of embodiments 1-121 or a pharmaceutical composition of embodiment 125 or 126, thereby treating the disorder.

138. The method of embodiment 134 or 137, wherein the SCN9A-associated disorder is pain, e.g., chronic pain.

139. The method of embodiment 138, wherein the chronic pain is associated with one or more of the disorders in the group consisting of pain hypersensitivity, pain hyposensitivity, inability to sense pain, primary erythromelalgia (PE), paroxysmal extreme pain disorder (PEPD), small fiber neuropathy (SFN), trigeminal neuralgia (TN), or pain associated with, e.g., cancer, arthritis, diabetes, traumatic injury or viral infections.

140. The method of any one of embodiments 137-139, wherein treating comprises amelioration of at least one sign or symptom of the disorder.

141. The method of embodiment 140, wherein at least one sign or symptom of pain, e.g., chronic pain comprises a measure of one or more of pain sensitivity, pain threshold, pain level, pain disability level presence, level, or activity of SCN9A (e.g., SCN9A gene, SCN9A mRNA, or SCN9A protein).

142. The method of any one of embodiments 137-139, where treating comprises prevention of progression of the disorder.

143. The method of any one of embodiments 137-142, wherein the treating comprises one or more of (a) reducing pain; or (b) inhibiting or reducing the expression or activity of SCN9A.

144. The method of embodiment 143, wherein the treating results in at least a 30% mean reduction from baseline of SCN9A mRNA in the dorsal root ganglion.

145. The method of embodiment 144, wherein the treating results in at least a 60% mean reduction from baseline of SCN9A mRNA in dorsal root ganglion.

146. The method of embodiment 145, wherein the treating results in at least a 90% mean reduction from baseline of SCN9 mRNA in the dorsal root ganglion.

147. The method of any one of embodiments 137-146, wherein after treatment the subject experiences at least an 8-week duration of knockdown following a single dose of dsRNA as assessed by SCN9A protein in a cerebral spinal fluid (CSF) sample or a CNS biopsy sample.

148. The method of embodiment 147, wherein treating results in at least a 12-week duration of knockdown following a single dose of dsRNA as assessed by SCN9A protein in a cerebral spinal fluid (CSF) sample or a CNS biopsy sample.

149. The method of embodiment 148, wherein treating results in at least a 16-week duration of knockdown following a single dose of dsRNA as assessed by SCN9A protein in a cerebral spinal fluid (CSF) sample or a CNS biopsy sample.

150. The method of any of embodiments 129-149, wherein the subject is human.

151. The method of any one of embodiments 130-150, wherein the dsRNA agent is administered at a dose of about 0.01 mg/kg to about 50 mg/kg.

152. The method of any one of embodiments 130-151, wherein the dsRNA agent is administered to the subject intracranially or intrathecally, 153. The method of any one of embodiments 130-151, wherein the dsRNA agent is administered to the subject intrathecally, intraventricularly, or intracerebrally.

154. The method of any one of embodiments 130-153, further comprising measuring level of SCN9A (e.g., SCN9A gene, SCN9A mRNA, or SCN9A protein) in the subject.

155. The method of embodiment 154, where measuring the level of SCN9A in the subject comprises measuring the level of SCN9A gene, SCN9A protein or SCN9A mRNA in a biological sample from the subject (e.g., a cerebral spinal fluid (CSF) sample or a CNS biopsy sample).

156. The method of any one of embodiments 130-155, further comprising performing a blood test, an imaging test, a CNS biopsy sample, or an aqueous cerebral spinal fluid biopsy.

157. The method of any one of embodiments 154-156, wherein measuring level of SCN9A (e.g., SCN9A gene, SCN9A mRNA, or SCN9A protein) in the subject is performed prior to treatment with the dsRNA agent or the pharmaceutical composition.

158. The method of embodiment 157, wherein, upon determination that a subject has a level of SCN9A (e.g., SCN9A gene, SCN9A mRNA, or SCN9A protein) that is greater than a reference level, the dsRNA agent or the pharmaceutical composition is administered to the subject.

159. The method of any one of embodiments 155-158, wherein measuring level of SCN9A (e.g., SCN9A gene, SCN9A mRNA, or SCN9A protein) in the subject is performed after treatment with the dsRNA agent or the pharmaceutical composition.

160. The method of any one of embodiments 137-159, further comprising administering to the subject an additional agent and/or therapy suitable for treatment or prevention of an SCN9A-associated disorder.
161. The method of embodiment 160, wherein the additional agent and/or therapy comprises one or more of a non-steroidal anti-inflammatory drugs (NSAIDs), acetaminophen, opioids, or corticosteroids, acupuncture, therapeutic massage, dorsal root ganglion stimulation, spinal cord stimulation, or topical pain relievers.

EXAMPLES

Example 1. SCN9A siRNA

Nucleic acid sequences provided herein are represented using standard nomenclature. See the abbreviations of Table 1.

TABLE 1

Abbreviations of nucleotide monomers used in nucleic acid sequence representation
It will be understood that these monomers, when present in an oligonucleotide, are mutually linked by 5'-3'-phosphodiester bonds; and it is understood that when the nucleotide contains a 2'-fluoro modification, then the fluoro replaces the hydroxy at that position in the parent nucleotide (i.e., it is a 2'-deoxy-2'-fluoronucleotide). . .

| Abbreviation | Nucleotide(s) |
|---|---|
| A | Adenosine-3'-phosphate |
| Ab | beta-L-adenosine-3'-phosphate |
| Abs | beta-L-adenosine-3'-phosphorothioate |
| Af | 2'-fluoroadenosine-3'-phosphate |
| Afs | 2'-fluoroadenosine-3'-phosphorothioate |
| (Ahd) | 2'-O-hexadecyl-adenosine-3'-phosphate |
| (Ahds) | 2'-O-hexadecyl-adenosine-3'-phosphorothioate |
| As | adenosine-3'-phosphorothioate |
| (A2p) | adenosine 2'-phosphate |
| C | cytidine-3'-phosphate |
| Cb | beta-L-cytidine-3'-phosphate |
| Cbs | beta-L-cytidine-3'-phosphorothioate |
| Cf | 2'-fluorocytidine-3'-phosphate |
| Cfs | 2'-fluorocytidine-3'-phosphorothioate |
| (Chd) | 2'-O-hexadecyl-cytidine-3'-phosphate |
| (Chds) | 2'-O-hexadecyl-cytidine-3'-phosphorothioate |
| Cs | cytidine-3'-phosphorothioate |
| (C2p) | cytosine 2'-phosphate |
| G | guanosine-3'-phosphate |
| Gb | beta-L-guanosine-3'-phosphate |
| Gbs | beta-L-guanosine-3'-phosphorothioate |
| Gf | 2'-fluoroguanosine-3'-phosphate |
| Gfs | 2'-fluoroguanosine-3'-phosphorothioate |
| (Ghd) | 2'-O-hexadecyl-guanosine-3'-phosphate |
| (Ghds) | 2'-O-hexadecyl-guanosine-3'-phosphorothioate |
| Gs | guanosine-3'-phosphorothioate |
| (G2p) | guanosine 2'-phosphate |
| T | 5'-methyluridine-3'-phosphate |
| Tb | beta-L-thymidine-3'-phosphate |
| Tbs | beta-L-thymidine-3'-phosphorothioate |
| Tf | 2'-fluoro-5-methyluridine-3'-phosphate |
| Tfs | 2'-fluoro-5-methyluridine-3'-phosphorothioate |
| Tgn | thymidine-glycol nucleic acid (GNA) S-Isomer |
| Agn | adenosine-glycol nucleic acid (GNA) S-Isomer |
| Cgn | cytidine-glycol nucleic acid (GNA) S-Isomer |
| Ggn | guanosine-glycol nucleic acid (GNA) S-Isomer |
| Ts | 5-methyluridine-3'-phosphorothioate |
| (T2p) | thymidine 2'-phosphate |
| U | Uridine-3'-phosphate |
| Ub | beta-L-uridine-3'-phosphate |
| Ubs | beta-L-uridine-3'-phosphorothioate |
| Uf | 2'-fluorouridine-3'-phosphate |
| Ufs | 2'-fluorouridine -3'-phosphorothioate |
| (Uhd) | 2'-O-hexadecyl-uridine-3'-phosphate |
| (Uhds) | 2'-O-hexadecyl-uridine-3'-phosphorothioate |
| Us | uridine -3'-phosphorothioate |
| (U2p) | uracil 2'-phosphate |
| N | any nucleotide (G, A, C, T or U) |
| VP | Vinyl phosphonate |
| a | 2'-O-methyladenosine-3'-phosphate |
| as | 2'-O-methyladenosine-3'-phosphorothioate |
| c | 2'-O-methylcytidine-3'-phosphate |
| cs | 2'-O-methylcytidine-3'-phosphorothioate |
| g | 2'-O-methylguanosine-3'-phosphate |
| gs | 2'-O-methylguanosine-3'-phosphorothioate |
| t | 2'-O-methyl-5-methyluridine-3'-phosphate |
| ts | 2'-O-methyl-5-methyluridine-3'-phosphorothioate |
| u | 2'-O-methyluridine-3'-phosphate |
| us | 2'-O-methyluridine-3'-phosphorothioate |
| dA | 2'-deoxyadenosine-3'-phosphate |

TABLE 1-continued

Abbreviations of nucleotide monomers used in nucleic acid sequence representation
It will be understood that these monomers, when present in an oligonucleotide, are mutually linked by 5'-3'-phosphodiester bonds; and it is understood that when the nucleotide contains a 2'-fluoro modification, then the fluoro replaces the hydroxy at that position in the parent nucleotide (i.e., it is a 2'-deoxy-2'-fluoronucleotide). . .

| Abbreviation | Nucleotide(s) |
|---|---|
| dAs | 2'-deoxyadenosine-3'-phosphorothioate |
| dC | 2'-deoxycytidine-3'-phosphate |
| dCs | 2'-deoxycytidine-3'-phosphorothioate |
| dG | 2'-deoxyguanosine-3'-phosphate |
| dGs | 2'-deoxyguanosine-3'-phosphorothioate |
| dT | 2'-deoxythymidine |
| dTs | 2'-deoxythymidine-3'-phosphorothioate |
| dU | 2'-deoxyuridine |
| s | phosphorothioate linkage |
| L96[1] | N-[tris(GalNAc-alkyl)-amidodecanoyl)]-4-hydroxyprolinol Hyp-(GalNAc-alkyl)3 |
| (Aeo) | 2'-O-methoxyethyladenosine-3'-phosphate |
| (Aeos) | 2'-O-methoxyethyladenosine-3'-phosphorothioate |
| (Geo) | 2'-O-methoxyethylguanosine-3'-phosphate |
| (Geos) | 2'-O-methoxyethylguanosine-3'-phosphorothioate |
| (Teo) | 2'-O-methoxyethyl-5-methyluridine-3'-phosphate |
| (Teos) | 2'-O-methoxyethyl-5-methyluridine-3'-phosphorothioate |
| (m5Ceo) | 2'-O-methoxyethyl-5-methylcytidine-3'-phosphate |
| (m5Ceos) | 2'-O-methoxyethyl-5-methylcytidine-3'-phosphorothioate |

[1]The chemical structure of L96 is as follows:

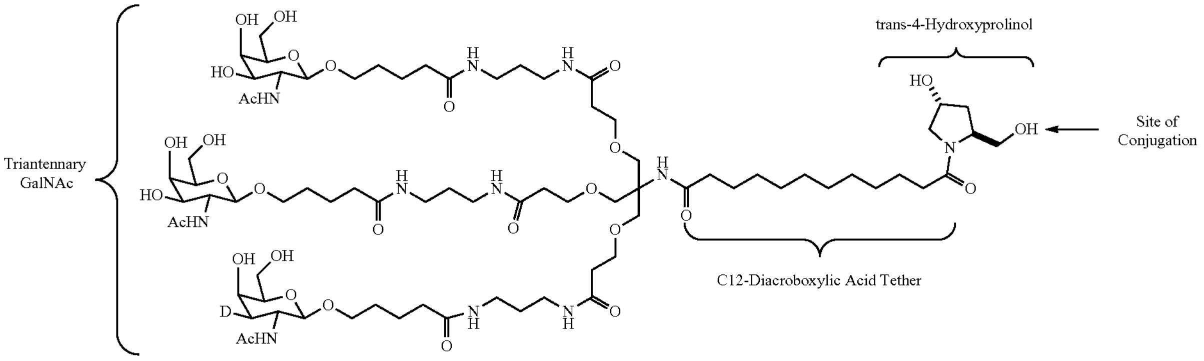

Experimental Methods

Bioinformatics

Transcripts

A set of siRNAs targeting the human SCN9A, "sodium channel, voltage gated, type IX alpha subunit" (human NCBI refseqID NM_002977.3; NCBI GeneID: 6335 or human: NCBI refseqID NM_001365536.1; NCBI GeneID: 6335) were generated. The human NM_002977.3 REFSEQ mRNA, has a length of 9771 bases. The human NM_001365536.1 REFSEQ mRNA, has a length of 9752 bases. Pairs of oligos were generated using bioinformatic methods and ranked, and exemplary pairs of oligos are shown in Table 2A, Table 2B, Table 4A, Table 4B, Table 5A, Table 5B, Table 6A, Table 6B, Table 13A, Table 13B, Table 14A, Table 14B, Table 15A, Table 15B, and Table 16. Modified sequences are presented in Table 2A, Table 4A, Table 5A, Table 6A, Table 13A, Table 14A, Table 15A, and Table 16. Unmodified sequences are presented in Table 2B, Table 4B, Table 5B, Table 6B, Table 13B, Table 14B, and Table 15B. The target mRNA source for each exemplary set of duplexes is in Tables 2A, 2B, 4A, 4B, 5A, 5B, 6A, 6B, 13A, 13B, 14A, 14B, 15A, 15B, and 16 are denoted in the tables. The number following the decimal point in a duplex name as indicated in the tables merely refers to a batch production number.

TABLE 2A

Exemplary Human SCN9A siRNA Modified Single Strands and Duplex Sequences

Column 1 indicates duplex name. Column 2 indicates the name of the sense sequence. Column 3 indicates the sequence ID for the sequence of column 4. Column 4 provides the modified sequence of a sense strand suitable for use in a duplex described herein. Column 5 indicates the antisense sequence name. Column 6 indicates the sequence ID for the sequence of column 7. Column 7 provides the sequence of a modified antisense strand suitable for use in a duplex described herein, e.g., a duplex comprising the sense sequence in the same row of the table. Column 8 indicates the position in the target mRNA (NM_002977.3) that is complementary to the antisense strand of Column 7. Column9 indicated the sequence ID for the sequence of column 8.

| Duplex Name | Sense sequence name | Seq ID NO: (sense) | Sense sequence (5'-3') | Antisense sequence name | Seq ID NO: (antisense) | Antisense sequence (5'-3') | mRNA target sequence in NM_002977.3 | Seq ID NO: (mRNA target) |
|---|---|---|---|---|---|---|---|---|
| AD-887232 | A-1683738.1 | 3 | UCACAAAACAGUCUCUUGCdTdT | A-1683739.1 | 4 | GCAAGAGACUGUUUUGUGAdTdT | UCACAAAACAGUCUCUUGC | 3039 |
| AD-887233 | A-1683740.1 | 5 | GGAAAACAAUCUUCCGUUUdTdT | A-1683741.1 | 6 | AAACGGAAGAUUGUUUUCCdTdT | GGAAAACAAUCUUCCGUUU | 3040 |
| AD-887234 | A-1683742.1 | 7 | GAAAACAAUCUUCCGUUUCdTdT | A-1683743.1 | 8 | GAAACGGAAGAUUGUUUUCdTdT | GAAAACAAUCUUCCGUUUC | 3041 |
| AD-887235 | A-1683744.1 | 9 | AAAACAAUCUUCCGUUUCAdTdT | A-1683745.1 | 10 | UGAAACGGAAGAUUGUUUUdTdT | AAAACAAUCUUCCGUUUCA | 3042 |
| AD-887236 | A-1683746.1 | 11 | AAACAAUCUUCCGUUUCAAdTdT | A-1683747.1 | 12 | UUGAAACGGAAGAUUGUUUdTdT | AAACAAUCUUCCGUUUCAA | 3043 |
| AD-887237 | A-1683748.1 | 13 | AACAAUCUUCCGUUUCAAUdTdT | A-1683749.1 | 14 | AUUGAAACGGAAGAUUGUUdTdT | AACAAUCUUCCGUUUCAAU | 3044 |
| AD-887238 | A-1683750.1 | 15 | CAAUCUUCCGUUUCAAUGCdTdT | A-1683751.1 | 16 | GCAUUGAAACGGAAGAUUGdTdT | CAAUCUUCCGUUUCAAUGC | 3045 |
| AD-887239 | A-1683752.1 | 17 | CCUGCUUUAUAUAUGCUUUdTdT | A-1683753.1 | 18 | AAAGCAUAUAUAAAGCAGGdTdT | CCUGCUUUAUAUAUGCUUU | 3046 |

TABLE 2A-continued

Exemplary Human SCN9A siRNA Modified Single Strands and Duplex Sequences
Column 1 indicates duplex name. Column 2 indicates the name of the sense sequence. Column 3 indicates the sequence ID for the sequence of column 4. Column 4 provides the modified sequence of a sense strand suitable for use in a duplex described herein. Column 5 indicates the antisense sequence name. Column 6 indicates the sequence ID for the sequence of column 7. Column 7 provides the sequence of a modified antisense strand suitable for use in a duplex described herein, e.g., a duplex comprising the sense sequence in the same row of the table. Column 8 indicates the position in the target mRNA (NM_002977.3) that is complementary to the antisense strand of Column 7. Column9 indicated the sequence ID for the sequence of column 8.

| Duplex Name | Sense sequence name | Seq ID NO: (sense) | Sense sequence (5'-3') | Antisense sequence name | Seq ID NO: (antisense) | Antisense sequence (5'-3') | mRNA target sequence in NM_002977.3 | Seq ID NO: (mRNA target) |
|---|---|---|---|---|---|---|---|---|
| AD-887240 | A-1683754.1 | 19 | CUGCUUUAUAUAUGCUUUCdTdT | A-1683755.1 | 20 | GAAAGCAUAUAUAAAGCAGdTdT | CUGCUUUAUAUAUGCUUUC | 3047 |
| AD-887241 | A-1683756.1 | 21 | UAUGCUUUCUCCUUUCAGUdTdT | A-1683757.1 | 22 | ACUGAAAGGAGAAAGCAUAdTdT | UAUGCUUUCUCCUUUCAGU | 3048 |
| AD-887242 | A-1683758.1 | 23 | AUGCUUUCUCCUUUCAGUCdTdT | A-1683759.1 | 24 | GACUGAAAGGAGAAAGCAUdTdT | AUGCUUUCUCCUUUCAGUC | 3049 |
| AD-887243 | A-1683760.1 | 25 | UGCUUUCUCCUUUCAGUCCdTdT | A-1683761.1 | 26 | GGACUGAAAGGAGAAAGCAdTdT | UGCUUUCUCCUUUCAGUCC | 3050 |
| AD-887244 | A-1683762.1 | 27 | cuuucuccuuucAGUCCUCdTdT | A-1683763.1 | 28 | GAGGACUGAAAGGAGAAAGdTdT | CUUUCUCCUUUCAGUCCUC | 3051 |
| AD-887245 | A-1683764.1 | 29 | UCUCCUUUCAGUCCUCUAAdTdT | A-1683765.1 | 30 | UUAGAGGACUGAAAGGAGAdTdT | UCUCCUUUCAGUCCUCUAA | 3052 |
| AD-887246 | A-1683766.1 | 31 | CUCCUUUCAGUCCUCUAAGdTdT | A-1683767.1 | 32 | CUUAGAGGACUGAAAGGAGdTdT | CUCCUUUCAGUCCUCUAAG | 3053 |
| AD-887247 | A-1683768.1 | 33 | UCCUUUCAGUCCUCUAAGAdTdT | A-1683769.1 | 34 | UCUUAGAGGACUGAAAGGAdTdT | UCCUUUCAGUCCUCUAAGA | 3054 |
| AD-887248 | A-1683770.1 | 35 | CCUUUCAGUCCUCUAAGAAdTdT | A-1683771.1 | 36 | UUCUUAGAGGACUGAAAGGdTdT | CCUUUCAGUCCUCUAAGAA | 3055 |
| AD-887249 | A-1683772.1 | 37 | CUUUCAGUCCUCUAAGAAGdTdT | A-1683773.1 | 38 | CUUCUUAGAGGACUGAAAGdTdT | CUUUCAGUCCUCUAAGAAG | 3056 |

TABLE 2A-continued

Exemplary Human SCN9A siRNA Modified Single Strands and Duplex Sequences
Column 1 indicates duplex name. Column 2 indicates the name of the sense sequence. Column 3 indicates the sequence ID for the sequence of column 4. Column 4 provides the modified sequence of a sense strand suitable for use in a duplex described herein. Column 5 indicates the antisense sequence name. Column 6 indicates the sequence ID for the sequence of column 7. Column 7 provides the sequence of a modified antisense strand suitable for use in a duplex described herein, e.g., a duplex comprising the sense sequence in the same row of the table. Column 8 indicates the position in the target mRNA (NM_002977.3) that is complementary to the antisense strand of Column 7. Column9 indicated the sequence ID for the sequence of column 8.

| Duplex Name | Sense sequence name | Seq ID NO: (sense) | Sense sequence (5'-3') | Antisense sequence name | Seq ID NO: (antisense) | Antisense sequence (5'-3') | mRNA target sequence in NM_002977.3 | Seq ID NO: (mRNA target) |
|---|---|---|---|---|---|---|---|---|
| AD-887250 | A-1683774.1 | 39 | AGUCCUCUAAGAAGAAUAUdTdT | A-1683775.1 | 40 | AUAUUCUUCUUAGAGGACUdTdT | AGUCCUCUAAGAAGAAUAU | 3057 |
| AD-887251 | A-1683776.1 | 41 | UCCUCUAAGAAGAAUAUCUdTdT | A-1683777.1 | 42 | AGAUAUUCUUCUUAGAGGAdTdT | UCCUCUAAGAAGAAUAUCU | 3058 |
| AD-887252 | A-1683778.1 | 43 | CCUCUAAGAAGAAUAUCUAdTdT | A-1683779.1 | 44 | UAGAUAUUCUUCUUAGAGGdTdT | CCUCUAAGAAGAAUAUCUA | 3059 |
| AD-887253 | A-1683780.1 | 45 | CUCUAAGAAGAAUAUCUAUdTdT | A-1683781.1 | 46 | AUAGAUAUUCUUCUUAGAGdTdT | CUCUAAGAAGAAUAUCUAU | 3060 |
| AD-887254 | A-1683782.1 | 47 | AUUUUAGUACACUCCUUAUdTdT | A-1683783.1 | 48 | AUAAGGAGUGUACUAAAAUdTdT | AUUUUAGUACACUCCUUAU | 3061 |
| AD-887255 | A-1683784.1 | 49 | UAGUACACUCCUUAUUCAGdTdT | A-1683785.1 | 50 | CUGAAUAAGGAGUGUACUAdTdT | UAGUACACUCCUUAUUCAG | 3062 |
| AD-887256 | A-1683786.1 | 51 | AGUACACUCCUUAUUCAGCdTdT | A-1683787.1 | 52 | GCUGAAUAAGGAGUGUACUdTdT | AGUACACUCCUUAUUCAGC | 3063 |
| AD-887257 | A-1683788.1 | 53 | CCUUAUUCAGCAUGCUCAUdTdT | A-1683789.1 | 54 | AUGAGCAUGCUGAAUAAGGdTdT | CCUUAUUCAGCAUGCUCAU | 3064 |
| AD-887258 | A-1683790.1 | 55 | UCAUCAUGUGCACUAUUCUdTdT | A-1683791.1 | 56 | AGAAUAGUGCACAUGAUGAdTdT | UCAUCAUGUGCACUAUUCU | 3065 |
| AD-887259 | A-1683792.1 | 57 | CAUCAUGUGCACUAUUCUGdTdT | A-1683793.1 | 58 | CAGAAUAGUGCACAUGAUGdTdT | CAUCAUGUGCACUAUUCUG | 3066 |
| AD- | A- | 59 | UGUCGAGUACAC | A-1683795.1 | 60 | AGUAAAAGUGUACU | UGUCGAGUACACUUU | 3067 |

TABLE 2A-continued

Exemplary Human SCN9A siRNA Modified Single Strands and Duplex Sequences
Column 1 indicates duplex name. Column 2 indicates the name of the sense sequence. Column 3 indicates the sequence ID for the sequence of column 4. Column 4 provides the modified sequence of a sense strand suitable for use in a duplex described herein. Column 5 indicates the antisense sequence name. Column 6 indicates the sequence ID for the sequence of column 7. Column 7 provides the sequence of a modified antisense strand suitable for use in a duplex described herein, e.g., a duplex comprising the sense sequence in the same row of the table. Column 8 indicates the position in the target mRNA (NM_002977.3) that is complementary to the antisense strand of Column 7. Column9 indicated the sequence ID for the sequence of column 8.

| Duplex Name | Sense sequence name | Seq ID NO: (sense) | Sense sequence (5'-3') | Antisense sequence name | Seq ID NO: (antisense) | Antisense sequence (5'-3') | mRNA target sequence in NM_002977.3 | Seq ID NO: (mRNA target) |
|---|---|---|---|---|---|---|---|---|
| 887260 | 1683794.1 | | UUUUACUdTdT | | | CGACAdTdT | UACU | |
| AD-887261 | A-1683796.1 | 61 | GUCGAGUACACUUUUACUGdTdT | A-1683797.1 | 62 | CAGUAAAAGUGUACUCGACdTdT | GUCGAGUACACUUUUACUG | 3068 |
| AD-887262 | A-1683798.1 | 63 | CUUCUGUGUAGGAGAAUUCdTdT | A-1683799.1 | 64 | GAAUUCUCCUACACAGAAGdTdT | CUUCUGUGUAGGAGAAUUC | 3069 |
| AD-887263 | A-1683800.1 | 65 | UAGGAGAAUUCACUUUUCUdTdT | A-1683801.1 | 66 | AGAAAAGUGAAUUCUCCUAdTdT | UAGGAGAAUUCACUUUUCU | 3070 |
| AD-887264 | A-1683802.1 | 67 | AGGAGAAUUCACUUUUCUUdTdT | A-1683803.1 | 68 | AAGAAAAGUGAAUUCUCCUdTdT | AGGAGAAUUCACUUUUCUU | 3071 |
| AD-887265 | A-1683804.1 | 69 | GGAGAAUUCACUUUUCUUCdTdT | A-1683805.1 | 70 | GAAGAAAAGUGAAUUCUCCdTdT | GGAGAAUUCACUUUUCUUC | 3072 |
| AD-887266 | A-1683806.1 | 71 | GGCAAUGUUUCAGCUCUUCdTdT | A-1683807.1 | 72 | GAAGAGCUGAAACAUUGCCdTdT | GGCAAUGUUUCAGCUCUUC | 3073 |
| AD-887267 | A-1683808.1 | 73 | AAUGUUUCAGCUCUUCGAAdTdT | A-1683809.1 | 74 | UUCGAAGAGCUGAAACAUUdTdT | AAUGUUUCAGCUCUUCGAA | 3074 |
| AD-887268 | A-1683810.1 | 75 | GUUUCAGCUCUUCGAACUUdTdT | A-1683811.1 | 76 | AAGUUCGAAGAGCUGAAACdTdT | GUUUCAGCUCUUCGAACUU | 3075 |
| AD-887269 | A-1683812.1 | 77 | UCAGCUCUUCGAACUUUCAdTdT | A-1683813.1 | 78 | UGAAAGUUCGAAGAGCUGAdTdT | UCAGCUCUUCGAACUUUCA | 3076 |

TABLE 2A-continued

Exemplary Human SCN9A siRNA Modified Single Strands and Duplex Sequences
Column 1 indicates duplex name. Column 2 indicates the name of the sense sequence. Column 3 indicates the sequence ID for the sequence of column 4. Column 4 provides the modified sequence of a sense strand suitable for use in a duplex described herein. Column 5 indicates the antisense sequence name. Column 6 indicates the sequence ID for the sequence of column 7. Column 7 provides the sequence of a modified antisense strand suitable for use in a duplex described herein, e.g., a duplex comprising the sense sequence in the same row of the table. Column 8 indicates the position in the target mRNA (NM_002977.3) that is complementary to the antisense strand of Column 7. Column9 indicated the sequence ID for the sequence of column 8.

| Duplex Name | Sense sequence name | Seq ID NO: (sense) | Sense sequence (5'-3') | Antisense sequence name | Seq ID NO: (antisense) | Antisense sequence (5'-3') | mRNA target sequence in NM_002977.3 | Seq ID NO: (mRNA target) |
|---|---|---|---|---|---|---|---|---|
| AD-887270 | A-1683814.1 | 79 | AGCUCUUCGAACUUUCAGAdTdT | A-1683815.1 | 80 | UCUGAAAGUUCGAAGAGCUdTdT | AGCUCUUCGAACUUUCAGA | 3077 |
| AD-887271 | A-1683816.1 | 81 | CUCUUCGAACUUUCAGAGUdTdT | A-1683817.1 | 82 | ACUCUGAAAGUUCGAAGAGdTdT | CUCUUCGAACUUUCAGAGU | 3078 |
| AD-887272 | A-1683818.1 | 83 | CUUCGAACUUUCAGAGUAUdTdT | A-1683819.1 | 84 | AUACUCUGAAAGUUCGAAGdTdT | CUUCGAACUUUCAGAGUAU | 3079 |
| AD-887273 | A-1683820.1 | 85 | UCCUGACUGUGUUCUGUCUdTdT | A-1683821.1 | 86 | AGACAGAACACAGUCAGGAdTdT | UCCUGACUGUGUUCUGUCU | 3080 |
| AD-887274 | A-1683822.1 | 87 | CUGACUGUGUUCUGUCUGAdTdT | A-1683823.1 | 88 | UCAGACAGAACACAGUCAGdTdT | CUGACUGUGUUCUGUCUGA | 3081 |
| AD-887275 | A-1683824.1 | 89 | UGACUGUGUUCUGUCUGAGdTdT | A-1683825.1 | 90 | CUCAGACAGAACACAGUCAdTdT | UGACUGUGUUCUGUCUGAG | 3082 |
| AD-887276 | A-1683826.1 | 91 | GACUGUGUUCUGUCUGAGUdTdT | A-1683827.1 | 92 | ACUCAGACAGAACACAGUCdTdT | GACUGUGUUCUGUCUGAGU | 3083 |
| AD-887277 | A-1683828.1 | 93 | ACUGUGUUCUGUCUGAGUGdTdT | A-1683829.1 | 94 | CACUCAGACAGAACACAGUdTdT | ACUGUGUUCUGUCUGAGUG | 3084 |
| AD-887278 | A-1683830.1 | 95 | CUGUGUUCUGUCUGAGUGUdTdT | A-1683831.1 | 96 | ACACUCAGACAGAACACAGdTdT | CUGUGUUCUGUCUGAGUGU | 3085 |
| AD-887279 | A-1683832.1 | 97 | UGUGUUCUGUCUGAGUGUGdTdT | A-1683833.1 | 98 | CACACUCAGACAGAACACAdTdT | UGUGUUCUGUCUGAGUGUG | 3086 |

TABLE 2A-continued

Exemplary Human SCN9A siRNA Modified Single Strands and Duplex Sequences
Column 1 indicates duplex name. Column 2 indicates the name of the sense sequence. Column 3 indicates the sequence ID for the sequence of column 4. Column 4 provides the modified sequence of a sense strand suitable for use in a duplex described herein. Column 5 indicates the antisense sequence name. Column 6 indicates the sequence ID for the sequence of column 7. Column 7 provides the sequence of a modified antisense strand suitable for use in a duplex described herein, e.g., a duplex comprising the sense sequence in the same row of the table. Column 8 indicates the position in the target mRNA (NM_002977.3) that is complementary to the antisense strand of Column 7. Column9 indicated the sequence ID for the sequence of column 8.

| Duplex Name | Sense sequence name | Seq ID NO: (sense) | Sense sequence (5'-3') | Antisense sequence name | Seq ID NO: (antisense) | Antisense sequence (5'-3') | mRNA target sequence in NM_002977.3 | Seq ID NO: (mRNA target) |
|---|---|---|---|---|---|---|---|---|
| AD-887280 | A-1683834.1 | 99 | UGUUCUGUCUGAGUGUGUUdTdT | A-1683835.1 | 100 | AACACACUCAGACAGAACAdTdT | UGUUCUGUCUGAGUGUGUU | 3087 |
| AD-887281 | A-1683836.1 | 101 | GUUCUGUCUGAGUGUGUUUdTdT | A-1683837.1 | 102 | AAACACACUCAGACAGAACdTdT | GUUCUGUCUGAGUGUGUUU | 3088 |
| AD-887282 | A-1683838.1 | 103 | UUCUGUCUGAGUGUGUUUGdTdT | A-1683839.1 | 104 | CAAACACACUCAGACAGAAdTdT | UUCUGUCUGAGUGUGUUUG | 3089 |
| AD-887283 | A-1683840.1 | 105 | UCUGUCUGAGUGUGUUUGCdTdT | A-1683841.1 | 106 | GCAAACACACUCAGACAGAdTdT | UCUGUCUGAGUGUGUUUGC | 3090 |
| AD-887284 | A-1683842.1 | 107 | UGCUCUCCUUUGUGGUUUCdTdT | A-1683843.1 | 108 | GAAACCACAAAGGAGAGCAdTdT | UGCUCUCCUUUGUGGUUUC | 3091 |
| AD-887285 | A-1683844.1 | 109 | CUCUCCUUUGUGGUUUCAGdTdT | A-1683845.1 | 110 | CUGAAACCACAAAGGAGAGdTdT | CUCUCCUUUGUGGUUUCAG | 3092 |
| AD-887286 | A-1683846.1 | 111 | UCUCCUUUGUGGUUUCAGCdTdT | A-1683847.1 | 112 | GCUGAAACCACAAAGGAGAdTdT | UCUCCUUUGUGGUUUCAGC | 3093 |
| AD-887287 | A-1683848.1 | 113 | CUCCUUUGUGGUUUCAGCAdTdT | A-1683849.1 | 114 | UGCUGAAACCACAAAGGAGdTdT | CUCCUUUGUGGUUUCAGCA | 3094 |
| AD-887288 | A-1683850.1 | 115 | CGAGCUUUGACACUUUCAGdTdT | A-1683851.1 | 116 | CUGAAAGUGUCAAAGCUCGdTdT | CGAGCUUUGACACUUUCAG | 3095 |
| AD-887289 | A-1683852.1 | 117 | ACAUGAUCUUCUUUGUCGUdTdT | A-1683853.1 | 118 | ACGACAAAGAAGAUCAUGUdTdT | ACAUGAUCUUCUUUGUCGU | 3096 |

TABLE 2A-continued

Exemplary Human SCN9A siRNA Modified Single Strands and Duplex Sequences
Column 1 indicates duplex name. Column 2 indicates the name of the sense sequence. Column 3 indicates the sequence ID for the sequence of column 4. Column 4 provides the modified sequence of a sense strand suitable for use in a duplex described herein. Column 5 indicates the antisense sequence name. Column 6 indicates the sequence ID for the sequence of column 7. Column 7 provides the sequence of a modified antisense strand suitable for use in a duplex described herein, e.g., a duplex comprising the sense sequence in the same row of the table. Column 8 indicates the position in the target mRNA (NM_002977.3) that is complementary to the antisense strand of Column 7. Column9 indicated the sequence ID for the sequence of column 8.

| Duplex Name | Sense sequence name | Seq ID NO: (sense) | Sense sequence (5'-3') | Antisense sequence name | Seq ID NO: (antisense) | Antisense sequence (5'-3') | mRNA target sequence in NM_002977.3 | Seq ID NO: (mRNA target) |
|---|---|---|---|---|---|---|---|---|
| AD-887290 | A-1683854.1 | 119 | CAUGAUCUUCUUUGUCGUAdTdT | A-1683855.1 | 120 | UACGACAAAGAAGAUCAUGdTdT | CAUGAUCUUCUUUGUCGUA | 3097 |
| AD-887291 | A-1683856.1 | 121 | GAUCUUCUUUGUCGUAGUGdTdT | A-1683857.1 | 122 | CACUACGACAAAGAAGAUCdTdT | GAUCUUCUUUGUCGUAGUG | 3098 |
| AD-887292 | A-1683858.1 | 123 | UCUUCUUUGUCGUAGUGAUdTdT | A-1683859.1 | 124 | AUCACUACGACAAAGAAGAdTdT | UCUUCUUUGUCGUAGUGAU | 3099 |
| AD-887293 | A-1683860.1 | 125 | CUUCUUUGUCGUAGUGAUUdTdT | A-1683861.1 | 126 | AAUCACUACGACAAAGAAGdTdT | CUUCUUUGUCGUAGUGAUU | 3100 |
| AD-887294 | A-1683862.1 | 127 | UUGUCGUAGUGAUUUUCCUdTdT | A-1683863.1 | 128 | AGGAAAAUCACUACGACAAdTdT | UUGUCGUAGUGAUUUUCCU | 3101 |
| AD-887295 | A-1683864.1 | 129 | GCUCCUUUUAUCUAAUAAAdTdT | A-1683865.1 | 130 | UUUAUUAGAUAAAAGGAGCdTdT | GCUCCUUUUAUCUAAUAAA | 3102 |
| AD-887296 | A-1683866.1 | 131 | CUCCUUUUAUCUAAUAAACdTdT | A-1683867.1 | 132 | GUUUAUUAGAUAAAAGGAGdTdT | CUCCUUUUAUCUAAUAAAC | 3103 |
| AD-887297 | A-1683868.1 | 133 | CCUCUCAGAGAGUUCUUCUdTdT | A-1683869.1 | 134 | AGAAGAACUCUCUGAGAGGdTdT | CCUCUCAGAGAGUUCUUCU | 3104 |
| AD-887298 | A-1683870.1 | 135 | CUCUCAGAGAGUUCUUCUGdTdT | A-1683871.1 | 136 | CAGAAGAACUCUCUGAGAGdTdT | CUCUCAGAGAGUUCUUCUG | 3105 |
| AD-887299 | A-1683872.1 | 137 | UCUCAGAGAGUUCUUCUGAdTdT | A-1683873.1 | 138 | UCAGAAGAACUCUCUGAGAdTdT | UCUCAGAGAGUUCUUCUGA | 3106 |

TABLE 2A-continued

Exemplary Human SCN9A siRNA Modified Single Strands and Duplex Sequences
Column 1 indicates duplex name. Column 2 indicates the name of the sense sequence. Column 3 indicates the sequence ID for the sequence of column 4. Column 4 provides the modified sequence of a sense strand suitable for use in a duplex described herein. Column 5 indicates the antisense sequence name. Column 6 indicates the sequence ID for the sequence of column 7. Column 7 provides the sequence of a modified antisense strand suitable for use in a duplex described herein, e.g., a duplex comprising the sense sequence in the same row of the table. Column 8 indicates the position in the target mRNA (NM_002977.3) that is complementary to the antisense strand of Column 7. Column9 indicated the sequence ID for the sequence of column 8.

| Duplex Name | Sense sequence name | Seq ID NO: (sense) | Sense sequence (5'-3') | Antisense sequence name | Seq ID NO: (antisense) | Antisense sequence (5'-3') | mRNA target sequence in NM_002977.3 | Seq ID NO: (mRNA target) |
|---|---|---|---|---|---|---|---|---|
| AD-887300 | A-1683874.1 | 139 | CUCAGAGAGUUCUUCUGAAdTdT | A-1683875.1 | 140 | UUCAGAAGAACUCUCUGAGdTdT | CUCAGAGAGUUCUUCUGAA | 3107 |
| AD-887301 | A-1683876.1 | 141 | UCAGAGAGUUCUUCUGAAAdTdT | A-1683877.1 | 142 | UUUCAGAAGAACUCUCUGAdTdT | UCAGAGAGUUCUUCUGAAA | 3108 |
| AD-887302 | A-1683878.1 | 143 | CAGAGAGUUCUUCUGAAACdTdT | A-1683879.1 | 144 | GUUUCAGAAGAACUCUCUGdTdT | CAGAGAGUUCUUCUGAAAC | 3109 |
| AD-887303 | A-1683880.1 | 145 | GAGAGUUCUUCUGAAACAUdTdT | A-1683881.1 | 146 | AUGUUUCAGAAGAACUCUCdTdT | GAGAGUUCUUCUGAAACAU | 3110 |
| AD-887304 | A-1683882.1 | 147 | AGAGUUCUUCUGAAACAUCdTdT | A-1683883.1 | 148 | GAUGUUUCAGAAGAACUCUdTdT | AGAGUUCUUCUGAAACAUC | 3111 |
| AD-887305 | A-1683884.1 | 149 | GAGUUCUUCUGAAACAUCCdTdT | A-1683885.1 | 150 | GGAUGUUUCAGAAGAACUCdTdT | GAGUUCUUCUGAAACAUCC | 3112 |
| AD-887306 | A-1683886.1 | 151 | AGUUCUUCUGAAACAUCCAdTdT | A-1683887.1 | 152 | UGGAUGUUUCAGAAGAACUdTdT | AGUUCUUCUGAAACAUCCA | 3113 |
| AD-887307 | A-1683888.1 | 153 | GUUCUUCUGAAACAUCCAAdTdT | A-1683889.1 | 154 | UUGGAUGUUUCAGAAGAACdTdT | GUUCUUCUGAAACAUCCAA | 3114 |
| AD-887308 | A-1683890.1 | 155 | UCUUCUGAAACAUCCAAACdTdT | A-1683891.1 | 156 | GUUUGGAUGUUUCAGAAGAdTdT | UCUUCUGAAACAUCCAAAC | 3115 |
| AD-887309 | A-1683892.1 | 157 | CUUCUGAAACAUCCAAACUdTdT | A-1683893.1 | 158 | AGUUUGGAUGUUUCAGAAGdTdT | CUUCUGAAACAUCCAACU | 3116 |

TABLE 2A-continued

Exemplary Human SCN9A siRNA Modified Single Strands and Duplex Sequences
Column 1 indicates duplex name. Column 2 indicates the name of the sense sequence. Column 3 indicates the sequence ID for the sequence of column 4. Column 4 provides the modified sequence of a sense strand suitable for use in a duplex described herein. Column 5 indicates the antisense sequence name. Column 6 indicates the sequence ID for the sequence of column 7. Column 7 provides the sequence of a modified antisense strand suitable for use in a duplex described herein, e.g., a duplex comprising the sense sequence in the same row of the table. Column 8 indicates the position in the target mRNA (NM_002977.3) that is complementary to the antisense strand of Column 7. Column9 indicated the sequence ID for the sequence of column 8.

| Duplex Name | Sense sequence name | Seq ID NO: (sense) | Sense sequence (5'-3') | Antisense sequence name | Seq ID NO: (antisense) | Antisense sequence (5'-3') | mRNA target sequence in NM_002977.3 | Seq ID NO: (mRNA target) |
|---|---|---|---|---|---|---|---|---|
| AD-887310 | A-1683894.1 | 159 | UCUGAAACAUCCAAACUGAdTdT | A-1683895.1 | 160 | UCAGUUUGGAUGUUUCAGAdTdT | UCUGAAACAUCCAAACUGA | 3117 |
| AD-887311 | A-1683896.1 | 161 | UCCAAACUGAGCUCUAAAAdTdT | A-1683897.1 | 162 | UUUUAGAGCUCAGUUUGGAdTdT | UCCAAACUGAGCUCUAAAA | 3118 |
| AD-887312 | A-1683898.1 | 163 | AGGCGUUGUAGUUCCUAUCdTdT | A-1683899.1 | 164 | GAUAGGAACUACAACGCCUdTdT | AGGCGUUGUAGUUCCUAUC | 3119 |
| AD-887313 | A-1683900.1 | 165 | GCGUUGUAGUUCCUAUCUCdTdT | A-1683901.1 | 166 | GAGAUAGGAACUACAACGCdTdT | GCGUUGUAGUUCCUAUCUC | 3120 |
| AD-887314 | A-1683902.1 | 167 | CGUUGUAGUUCCUAUCUCCdTdT | A-1683903.1 | 168 | GGAGAUAGGAACUACAACGdTdT | CGUUGUAGUUCCUAUCUCC | 3121 |
| AD-887315 | A-1683904.1 | 169 | GUUGUAGUUCCUAUCUCCUdTdT | A-1683905.1 | 170 | AGGAGAUAGGAACUACAACdTdT | GUUGUAGUUCCUAUCuccu | 3122 |
| AD-887316 | A-1683906.1 | 171 | UUGUAGUUCCUAUCUCCUUdTdT | A-1683907.1 | 172 | AAGGAGAUAGGAACUACAAdTdT | UUGUAGUUCCUAUCUCCUU | 3123 |
| AD-887317 | A-1683908.1 | 173 | UGUAGUUCCUAUCUCCUUUdTdT | A-1683909.1 | 174 | AAAGGAGAUAGGAACUACAdTdT | UGUAGUUCCUAUCUCCUUU | 3124 |
| AD-887318 | A-1683910.1 | 175 | GUAGUUCCUAUCUCCUUUCdTdT | A-1683911.1 | 176 | GAAAGGAGAUAGGAACUACdTdT | GUAGUUCCUAUCUCCUUUC | 3125 |
| AD-887319 | A-1683912.1 | 177 | UAGUUCCUAUCUCCUUUCAdTdT | A-1683913.1 | 178 | UGAAAGGAGAUAGGAACUAdTdT | UAGUUCCUAUCUCCUUUCA | 3126 |

TABLE 2A-continued

Exemplary Human SCN9A siRNA Modified Single Strands and Duplex Sequences
Column 1 indicates duplex name. Column 2 indicates the name of the sense sequence. Column 3 indicates the sequence ID for the sequence of column 4. Column 4 provides the modified sequence of a sense strand suitable for use in a duplex described herein. Column 5 indicates the antisense sequence name. Column 6 indicates the sequence ID for the sequence of column 7. Column 7 provides the sequence of a modified antisense strand suitable for use in a duplex described herein, e.g., a duplex comprising the sense sequence in the same row of the table. Column 8 indicates the position in the target mRNA (NM_002977.3) that is complementary to the antisense strand of Column 7. Column9 indicated the sequence ID for the sequence of column 8.

| Duplex Name | Sense sequence name | Seq ID NO: (sense) | Sense sequence (5'-3') | Antisense sequence name | Seq ID NO: (antisense) | Antisense sequence (5'-3') | mRNA target sequence in NM_002977.3 | Seq ID NO: (mRNA target) |
|---|---|---|---|---|---|---|---|---|
| AD-887320 | A-1683914.1 | 179 | AGUUCCUAUCUCCUUUCAGdTdT | A-1683915.1 | 180 | CUGAAAGGAGAUAGGAACUdTdT | AGUUCCUAUCUCCUUUCAG | 3127 |
| AD-887321 | A-1683916.1 | 181 | GUUCCUAUCUCCUUUCAGAdTdT | A-1683917.1 | 182 | UCUGAAAGGAGAUAGGAACdTdT | GUUCCUAUCUCCUUUCAGA | 3128 |
| AD-887322 | A-1683918.1 | 183 | UUCCUAUCUCCUUUCAGAGdTdT | A-1683919.1 | 184 | CUCUGAAAGGAGAUAGGAAdTdT | UUCCUAUCUCCUUUCAGAG | 3129 |
| AD-887323 | A-1683920.1 | 185 | UCCUAUCUCCUUUCAGAGGdTdT | A-1683921.1 | 186 | CCUCUGAAAGGAGAUAGGAdTdT | UCCUAUCUCCUUUCAGAGG | 3130 |
| AD-887324 | A-1683922.1 | 187 | UCUCCUUUCAGAGGAUAUGdTdT | A-1683923.1 | 188 | CAUAUCCUCUGAAAGGAGAdTdT | UCUCCUUUCAGAGGAUAUG | 3131 |
| AD-887325 | A-1683924.1 | 189 | GCAUAUUAACAAACACUGUdTdT | A-1683925.1 | 190 | ACAGUGUUUGUUAAUAUGCdTdT | GCAUAUUAACAAACACUGU | 3132 |
| AD-887326 | A-1683926.1 | 191 | CUUGAUCUGGAAUUGCUCUdTdT | A-1683927.1 | 192 | AGAGCAAUUCCAGAUCAAGdTdT | CUUGAUCUGGAAUUGCUCU | 3133 |
| AD-887327 | A-1683928.1 | 193 | CUCUCCAUAUUGGAUAAAAdTdT | A-1683929.1 | 194 | UUUUAUCCAAUAUGGAGAGdTdT | CUCUCCAUAUUGGAUAAAA | 3134 |
| AD-887328 | A-1683930.1 | 195 | UCUCCAUAUUGGAUAAAAUdTdT | A-1683931.1 | 196 | AUUUUAUCCAAUAUGGAGAdTdT | UCUCCAUAUUGGAUAAAAU | 3135 |
| AD-887329 | A-1683932.1 | 197 | CUCCAUAUUGGAUAAAAUUdTdT | A-1683933.1 | 198 | AAUUUUAUCCAAUAUGGAGdTdT | CUCCAUAUUGGAUAAAAUU | 3136 |
| AD- | A- | 199 | GAUCUUGCAAUU | A-1683935.1 | 200 | AAAUGGUAAUUGCA | GAUCUUGCAAUUACC | 3137 |

TABLE 2A-continued

Exemplary Human SCN9A siRNA Modified Single Strands and Duplex Sequences
Column 1 indicates duplex name. Column 2 indicates the name of the sense sequence. Column 3 indicates the sequence ID for the sequence of column 4. Column 4 provides the modified sequence of a sense strand suitable for use in a duplex described herein. Column 5 indicates the antisense sequence name. Column 6 indicates the sequence ID for the sequence of column 7. Column 7 provides the sequence of a modified antisense strand suitable for use in a duplex described herein, e.g., a duplex comprising the sense sequence in the same row of the table. Column 8 indicates the position in the target mRNA (NM_002977.3) that is complementary to the antisense strand of Column 7. Column9 indicated the sequence ID for the sequence of column 8.

| Duplex Name | Sense sequence name | Seq ID NO: (sense) | Sense sequence (5'-3') | Antisense sequence name | Seq ID NO: (antisense) | Antisense sequence (5'-3') | mRNA target sequence in NM_002977.3 | Seq ID NO: (mRNA target) |
|---|---|---|---|---|---|---|---|---|
| 887330 | 1683934.1 | | ACCAUUUdTdT | | | AGAUCdTdT | AUUU | |
| AD-887331 | A-1683936.1 | 201 | UUGGUCUUUACUGGAAUCUdTdT | A-1683937.1 | 202 | AGAUUCCAGUAAAGACCAAdTdT | UUGGUCUUUACUGGAAUCU | 3138 |
| AD-887332 | A-1683938.1 | 203 | GGUCUUUACUGGAAUCUUUdTdT | A-1683939.1 | 204 | AAAGAUUCCAGUAAAGACCdTdT | GGUCUUUACUGGAAUCUUU | 3139 |
| AD-887333 | A-1683940.1 | 205 | GUCUUUACUGGAAUCUUUGdTdT | A-1683941.1 | 206 | CAAAGAUUCCAGUAAAGACdTdT | GUCUUUACUGGAAUCUUUG | 3140 |
| AD-887334 | A-1683942.1 | 207 | GCCUUAUUGUGACUUUAAGdTdT | A-1683943.1 | 208 | CUUAAAGUCACAAUAAGGCdTdT | GCCUUAUUGUGACUUUAAG | 3141 |
| AD-887335 | A-1683944.1 | 209 | GCUCUUUCUAGCAGAUGUGdTdT | A-1683945.1 | 210 | CACAUCUGCUAGAAAGAGCdTdT | GCUCUUUCUAGCAGAUGUG | 3142 |
| AD-887336 | A-1683946.1 | 211 | CUCUUUCUAGCAGAUGUGGdTdT | A-1683947.1 | 212 | CCACAUCUGCUAGAAAGAGdTdT | CUCUUUCUAGCAGAUGUGG | 3143 |
| AD-887337 | A-1683948.1 | 213 | GUCAGUUCUGCGAUCAUUCdTdT | A-1683949.1 | 214 | GAAUGAUCGCAGAACUGACdTdT | GUCAGUUCUGCGAUCAUUC | 3144 |
| AD-887338 | A-1683950.1 | 215 | UCAGUUCUGCGAUCAUUCAdTdT | A-1683951.1 | 216 | UGAAUGAUCGCAGAACUGAdTdT | UCAGUUCUGCGAUCAUUCA | 3145 |
| AD-887339 | A-1683952.1 | 217 | AGUCUUCAAGUUGGCAAAAdTdT | A-1683953.1 | 218 | UUUUGCCAACUUGAAGACUdTdT | AGUCUUCAAGUUGGCAAAA | 3146 |

TABLE 2A-continued

Exemplary Human SCN9A siRNA Modified Single Strands and Duplex Sequences
Column 1 indicates duplex name. Column 2 indicates the name of the sense sequence. Column 3 indicates the sequence ID for the sequence of column 4. Column 4 provides the modified sequence of a sense strand suitable for use in a duplex described herein. Column 5 indicates the antisense sequence name. Column 6 indicates the sequence ID for the sequence of column 7. Column 7 provides the sequence of a modified antisense strand suitable for use in a duplex described herein, e.g., a duplex comprising the sense sequence in the same row of the table. Column 8 indicates the position in the target mRNA (NM_002977.3) that is complementary to the antisense strand of Column 7. Column9 indicated the sequence ID for the sequence of column 8.

| Duplex Name | Sense sequence name | Seq ID NO: (sense) | Sense sequence (5'-3') | Antisense sequence name | Seq ID NO: (antisense) | Antisense sequence (5'-3') | mRNA target sequence in NM_002977.3 | Seq ID NO: (mRNA target) |
|---|---|---|---|---|---|---|---|---|
| AD-887340 | A-1683954.1 | 219 | UCUUCAAGUUGGCAAAAUCdTdT | A-1683955.1 | 220 | GAUUUUGCCAACUUGAAGAdTdT | UCUUCAAGUUGGCAAAAUC | 3147 |
| AD-887341 | A-1683956.1 | 221 | CUUCAAGUUGGCAAAAUCCdTdT | A-1683957.1 | 222 | GGAUUUUGCCAACUUGAAGdTdT | CUUCAAGUUGGCAAAAUCC | 3148 |
| AD-887342 | A-1683958.1 | 223 | CCAUCAUCGUCUUCAUUUUdTdT | A-1683959.1 | 224 | AAAAUGAAGACGAUGAUGGdTdT | CCAUCAUCGUCUUCAUUUU | 3149 |
| AD-887343 | A-1683960.1 | 225 | CAUCAUCGUCUUCAUUUUUdTdT | A-1683961.1 | 226 | AAAAAUGAAGACGAUGAUGdTdT | CAUCAUCGUCUUCAUUUUU | 3150 |
| AD-887344 | A-1683962.1 | 227 | GCACAUGAACGACUUCUUCdTdT | A-1683963.1 | 228 | GAAGAAGUCGUUCAUGUGCdTdT | GCACAUGAACGACUUCUUC | 3151 |
| AD-887345 | A-1683964.1 | 229 | CACAUGAACGACUUCUUCCdTdT | A-1683965.1 | 230 | GGAAGAAGUCGUUCAUGUGdTdT | CACAUGAACGACUUCUUCC | 3152 |
| AD-887346 | A-1683966.1 | 231 | ACAUGAACGACUUCUUCCAdTdT | A-1683967.1 | 232 | UGGAAGAAGUCGUUCAUGUdTdT | ACAUGAACGACUUCUUCCA | 3153 |
| AD-887347 | A-1683968.1 | 233 | CAUGAACGACUUCUUCCACdTdT | A-1683969.1 | 234 | GUGGAAGAAGUCGUUCAUGdTdT | CAUGAACGACUUCUUCCAC | 3154 |
| AD-887348 | A-1683970.1 | 235 | UGAACGACUUCUUCCACUCdTdT | A-1683971.1 | 236 | GAGUGGAAGAAGUCGUUCAdTdT | UGAACGACUUCUUCCACUC | 3155 |
| AD-887349 | A-1683972.1 | 237 | CGACUUCUUCCACUCCUUCdTdT | A-1683973.1 | 238 | GAAGGAGUGGAAGAAGUCGdTdT | CGACUUCUUCCACUCCUUC | 3156 |

TABLE 2A-continued

Exemplary Human SCN9A siRNA Modified Single Strands and Duplex Sequences
Column 1 indicates duplex name. Column 2 indicates the name of the sense sequence. Column 3 indicates the sequence ID for the sequence of column 4. Column 4 provides the modified sequence of a sense strand suitable for use in a duplex described herein. Column 5 indicates the antisense sequence name. Column 6 indicates the sequence ID for the sequence of column 7. Column 7 provides the sequence of a modified antisense strand suitable for use in a duplex described herein, e.g., a duplex comprising the sense sequence in the same row of the table. Column 8 indicates the position in the target mRNA (NM_002977.3) that is complementary to the antisense strand of Column 7. Column9 indicated the sequence ID for the sequence of column 8.

| Duplex Name | Sense sequence name | Seq ID NO: (sense) | Sense sequence (5'-3') | Antisense sequence name | Seq ID NO: (antisense) | Antisense sequence (5'-3') | mRNA target sequence in NM_002977.3 | Seq ID NO: (mRNA target) |
|---|---|---|---|---|---|---|---|---|
| AD-887350 | A-1683974.1 | 239 | UCCACUCCUUCCUGAUUGUdTdT | A-1683975.1 | 240 | ACAAUCAGGAAGGAGUGGAdTdT | UCCACUCCUUCCUGAUUGU | 3157 |
| AD-887351 | A-1683976.1 | 241 | ACUCCUUCCUGAUUGUGUUdTdT | A-1683977.1 | 242 | AACACAAUCAGGAAGGAGUdTdT | ACUCCUUCCUGAUUGUGUU | 3158 |
| AD-887352 | A-1683978.1 | 243 | CUCCUUCCUGAUUGUGUUCdTdT | A-1683979.1 | 244 | GAACACAAUCAGGAAGGAGdTdT | CUCCUUCCUGAUUGUGUUC | 3159 |
| AD-887353 | A-1683980.1 | 245 | UCCUUCCUGAUUGUGUUCCdTdT | A-1683981.1 | 246 | GGAACACAAUCAGGAAGGAdTdT | UCCUUCCUGAUUGUGUUCC | 3160 |
| AD-887354 | A-1683982.1 | 247 | CUAUGUGCCUUAUUGUUUAdTdT | A-1683983.1 | 248 | UAAACAAUAAGGCACAUAGdTdT | CUAUGUGCCUUAUUGUUUA | 3161 |
| AD-887355 | A-1683984.1 | 249 | UGGUCCUAAACCUAUUUCUdTdT | A-1683985.1 | 250 | AGAAAUAGGUUUAGGACCAdTdT | UGGUCCUAAACCUAUUUCU | 3162 |
| AD-887356 | A-1683986.1 | 251 | GGUCCUAAACCUAUUUCUGdTdT | A-1683987.1 | 252 | CAGAAAUAGGUUUAGGACCdTdT | GGUCCUAAACCUAUUUCUG | 3163 |
| AD-887357 | A-1683988.1 | 253 | GUCCUAAACCUAUUUCUGGdTdT | A-1683989.1 | 254 | CCAGAAAUAGGUUUAGGACdTdT | GUCCUAAACCUAUUUCUGG | 3164 |
| AD-887358 | A-1683990.1 | 255 | CCUUACGUGAAUUUAUUCUdTdT | A-1683991.1 | 256 | AGAAUAAAUUCACGUAAGGdTdT | CCUUACGUGAAUUUAUUCU | 3165 |
| AD-887359 | A-1683992.1 | 257 | CAAAGGUCACAAUUUCCUCdTdT | A-1683993.1 | 258 | GAGGAAAUUGUGACCUUUGdTdT | CAAAGGUCACAAUUUCCUC | 3166 |

TABLE 2A-continued

Exemplary Human SCN9A siRNA Modified Single Strands and Duplex Sequences
Column 1 indicates duplex name. Column 2 indicates the name of the sense sequence. Column 3 indicates the sequence ID for the sequence of column 4. Column 4 provides the modified sequence of a sense strand suitable for use in a duplex described herein. Column 5 indicates the antisense sequence name. Column 6 indicates the sequence ID for the sequence of column 7. Column 7 provides the sequence of a modified antisense strand suitable for use in a duplex described herein, e.g., a duplex comprising the sense sequence in the same row of the table. Column 8 indicates the position in the target mRNA (NM_002977.3) that is complementary to the antisense strand of Column 7. Column9 indicated the sequence ID for the sequence of column 8.

| Duplex Name | Sense sequence name | Seq ID NO: (sense) | Sense sequence (5'-3') | Antisense sequence name | Seq ID NO: (antisense) | Antisense sequence (5'-3') | mRNA target sequence in NM_002977.3 | Seq ID NO: (mRNA target) |
|---|---|---|---|---|---|---|---|---|
| AD-887360 | A-1683994.1 | 259 | UCACAAUUUCCUCAAGGAAdTdT | A-1683995.1 | 260 | UUCCUUGAGGAAAUUGUGAdTdT | UCACAAUUUCCUCAAGGAA | 3167 |
| AD-887361 | A-1683996.1 | 261 | CCUCAAGGAAAAAGAUAAAdTdT | A-1683997.1 | 262 | UUUAUCUUUUUCCUUGAGGdTdT | CCUCAAGGAAAAAGAUAAA | 3168 |
| AD-887362 | A-1683998.1 | 263 | GCUUCAUUGUCCUCAUGAUdTdT | A-1683999.1 | 264 | AUCAUGAGGACAAUGAAGCdTdT | GCUUCAUUGUCCUCAUGAU | 3169 |
| AD-887363 | A-1684000.1 | 265 | CUUCAUUGUCCUCAUGAUCdTdT | A-1684001.1 | 266 | GAUCAUGAGGACAAUGAAGdTdT | CUUCAUUGUCCUCAUGAUC | 3170 |
| AD-887364 | A-1684002.1 | 267 | UGCAGACAAGAUCUUCACUdTdT | A-1684003.1 | 268 | AGUGAAGAUCUUGUCUGCAdTdT | UGCAGACAAGAUCUUCACU | 3171 |
| AD-887365 | A-1684004.1 | 269 | CAGACAAGAUCUUCACUUAdTdT | A-1684005.1 | 270 | UAAGUGAAGAUCUUGUCUGdTdT | CAGACAAGAUCUUCACUUA | 3172 |
| AD-887366 | A-1684006.1 | 271 | AGACAAGAUCUUCACUUACdTdT | A-1684007.1 | 272 | GUAAGUGAAGAUCUUGUCUdTdT | AGACAAGAUCUUCACUUAC | 3173 |
| AD-887367 | A-1684008.1 | 273 | GACAAGAUCUUCACUUACAdTdT | A-1684009.1 | 274 | UGUAAGUGAAGAUCUUGUCdTdT | GACAAGAUCUUCACUUACA | 3174 |
| AD-887368 | A-1684010.1 | 275 | ACAAGAUCUUCACUUACAUdTdT | A-1684011.1 | 276 | AUGUAAGUGAAGAUCUUGUdTdT | ACAAGAUCUUCACUUACAU | 3175 |
| AD-887369 | A-1684012.1 | 277 | CAAGAUCUUCACUUACAUCdTdT | A-1684013.1 | 278 | GAUGUAAGUGAAGAUCUUGdTdT | CAAGAUCUUCACUUACAUC | 3176 |

TABLE 2A-continued

Exemplary Human SCN9A siRNA Modified Single Strands and Duplex Sequences
Column 1 indicates duplex name. Column 2 indicates the name of the sense sequence. Column 3 indicates the sequence ID for the sequence of column 4. Column 4 provides the modified sequence of a sense strand suitable for use in a duplex described herein. Column 5 indicates the antisense sequence name. Column 6 indicates the sequence ID for the sequence of column 7. Column 7 provides the sequence of a modified antisense strand suitable for use in a duplex described herein, e.g., a duplex comprising the sense sequence in the same row of the table. Column 8 indicates the position in the target mRNA (NM_002977.3) that is complementary to the antisense strand of Column 7. Column9 indicated the sequence ID for the sequence of column 8.

| Duplex Name | Sense sequence name | Seq ID NO: (sense) | Sense sequence (5'-3') | Antisense sequence name | Seq ID NO: (antisense) | Antisense sequence (5'-3') | mRNA target sequence in NM_002977.3 | Seq ID NO: (mRNA target) |
|---|---|---|---|---|---|---|---|---|
| AD-887370 | A-1684014.1 | 279 | AGAUCUUCACUUACAUCUUdTdT | A-1684015.1 | 280 | AAGAUGUAAGUGAAGAUCUdTdT | AGAUCUUCACUUACAUCUU | 3177 |
| AD-887371 | A-1684016.1 | 281 | GAUCUUCACUUACAUCUUCdTdT | A-1684017.1 | 282 | GAAGAUGUAAGUGAAGAUCdTdT | GAUCUUCACUUACAUCUUC | 3178 |
| AD-887372 | A-1684018.1 | 283 | UCUUCACUUACAUCUUCAUdTdT | A-1684019.1 | 284 | AUGAAGAUGUAAGUGAAGAdTdT | UCUUCACUUACAUCUUCAU | 3179 |
| AD-887373 | A-1684020.1 | 285 | CUUCACUUACAUCUUCAUUdTdT | A-1684021.1 | 286 | AAUGAAGAUGUAAGUGAAGdTdT | CUUCACUUACAUCUUCAUU | 3180 |
| AD-887374 | A-1684022.1 | 287 | UUCACUUACAUCUUCAUUCdTdT | A-1684023.1 | 288 | GAAUGAAGAUGUAAGUGAAdTdT | UUCACUUACAUCUUCAUUC | 3181 |
| AD-887375 | A-1684024.1 | 289 | UCACUUACAUCUUCAUUCUdTdT | A-1684025.1 | 290 | AGAAUGAAGAUGUAAGUGAdTdT | UCACUUACAUCUUCAUUCU | 3182 |
| AD-887376 | A-1684026.1 | 291 | CACUUACAUCUUCAUUCUGdTdT | A-1684027.1 | 292 | CAGAAUGAAGAUGUAAGUGdTdT | CACUUACAUCUUCAUUCUG | 3183 |
| AD-887377 | A-1684028.1 | 293 | CUUACAUCUUCAUUCUGGAdTdT | A-1684029.1 | 294 | UCCAGAAUGAAGAUGUAAGdTdT | CUUACAUCUUCAUUCUGGA | 3184 |
| AD-887378 | A-1684030.1 | 295 | ACAUCUUCAUUCUGGAAAUdTdT | A-1684031.1 | 296 | AUUUCCAGAAUGAAGAUGUdTdT | ACAUCUUCAUUCUGGAAAU | 3185 |
| AD-887379 | A-1684032.1 | 297 | CAUCUUCAUUCUGGAAAUGdTdT | A-1684033.1 | 298 | CAUUUCCAGAAUGAAGAUGdTdT | CAUCUUCAUUCUGGAAAUG | 3186 |

TABLE 2A-continued

Exemplary Human SCN9A siRNA Modified Single Strands and Duplex Sequences
Column 1 indicates duplex name. Column 2 indicates the name of the sense sequence. Column 3 indicates the sequence ID for the sequence of column 4. Column 4 provides the modified sequence of a sense strand suitable for use in a duplex described herein. Column 5 indicates the antisense sequence name. Column 6 indicates the sequence ID for the sequence of column 7. Column 7 provides the sequence of a modified antisense strand suitable for use in a duplex described herein, e.g., a duplex comprising the sense sequence in the same row of the table. Column 8 indicates the position in the target mRNA (NM_002977.3) that is complementary to the antisense strand of Column 7. Column9 indicated the sequence ID for the sequence of column 8.

| Duplex Name | Sense sequence name | Seq ID NO: (sense) | Sense sequence (5'-3') | Antisense sequence name | Seq ID NO: (antisense) | Antisense sequence (5'-3') | mRNA target sequence in NM_002977.3 | Seq ID NO: (mRNA target) |
|---|---|---|---|---|---|---|---|---|
| AD-887380 | A-1684034.1 | 299 | UCUUCAUUCUGGAAAUGCUdTdT | A-1684035.1 | 300 | AGCAUUUCCAGAAUGAAGAdTdT | UCUUCAUUCUGGAAAUGCU | 3187 |
| AD-887381 | A-1684036.1 | 301 | CUUCAUUCUGGAAAUGCUUdTdT | A-1684037.1 | 302 | AAGCAUUUCCAGAAUGAAGdTdT | CUUCAUUCUGGAAAUGCUU | 3188 |
| AD-887382 | A-1684038.1 | 303 | UCUGGAAAUGCUUCUAAAAdTdT | A-1684039.1 | 304 | UUUUAGAAGCAUUUCCAGAdTdT | UCUGGAAAUGCUUCUAAAA | 3189 |
| AD-887383 | A-1684040.1 | 305 | GCUGGAUUUCCUAAUUGUUdTdT | A-1684041.1 | 306 | AACAAUUAGGAAAUCCAGCdTdT | GCUGGAUUUCCUAAUUGUU | 3190 |
| AD-887384 | A-1684042.1 | 307 | CUGGAUUUCCUAAUUGUUGdTdT | A-1684043.1 | 308 | CAACAAUUAGGAAAUCCAGdTdT | CUGGAUUUCCUAAUUGUUG | 3191 |
| AD-887385 | A-1684044.1 | 309 | CCUCUAAGAGCCUUAUCUAdTdT | A-1684045.1 | 310 | UAGAUAAGGCUCUUAGAGGdTdT | CCUCUAAGAGCCUUAUCUA | 3192 |
| AD-887386 | A-1684046.1 | 311 | CUCUAAGAGCCUUAUCUAGdTdT | A-1684047.1 | 312 | CUAGAUAAGGCUCUUAGAGdTdT | CUCUAAGAGCCUUAUCUAG | 3193 |
| AD-887387 | A-1684048.1 | 313 | CUUCCAUCAUGAAUGUGCUdTdT | A-1684049.1 | 314 | AGCACAUUCAUGAUGGAAGdTdT | CUUCCAUCAUGAAUGUGCU | 3194 |
| AD-887388 | A-1684050.1 | 315 | UUUCCUGCAAGUCAAGUUCdTdT | A-1684051.1 | 316 | GAACUUGACUUGCAGGAAAdTdT | UUUCCUGCAAGUCAAGUUC | 3195 |
| AD-887389 | A-1684052.1 | 317 | CUGCAAGUCAAGUUCCAAAdTdT | A-1684053.1 | 318 | UUUGGAACUUGACUUGCAGdTdT | CUGCAAGUCAAGUUCCAAA | 3196 |

TABLE 2A-continued

Exemplary Human SCN9A siRNA Modified Single Strands and Duplex Sequences
Column 1 indicates duplex name. Column 2 indicates the name of the sense sequence. Column 3 indicates the sequence ID for the sequence of column 4. Column 4 provides the modified sequence of a sense strand suitable for use in a duplex described herein. Column 5 indicates the antisense sequence name. Column 6 indicates the sequence ID for the sequence of column 7. Column 7 provides the sequence of a modified antisense strand suitable for use in a duplex described herein, e.g., a duplex comprising the sense sequence in the same row of the table. Column 8 indicates the position in the target mRNA (NM_002977.3) that is complementary to the antisense strand of Column 7. Column9 indicated the sequence ID for the sequence of column 8.

| Duplex Name | Sense sequence name | Seq ID NO: (sense) | Sense sequence (5'-3') | Antisense sequence name | Seq ID NO: (antisense) | Antisense sequence (5'-3') | mRNA target sequence in NM_002977.3 | Seq ID NO: (mRNA target) |
|---|---|---|---|---|---|---|---|---|
| AD-887390 | A-1684054.1 | 319 | AGUCAAGUUCCAAAUCGUUdTdT | A-1684055.1 | 320 | AACGAUUUGGAACUUGACUdTdT | AGUCAAGUUCCAAAUCGUU | 3197 |
| AD-887391 | A-1684056.1 | 321 | ACUUGGUUACCUAUCUCUGdTdT | A-1684057.1 | 322 | CAGAGAUAGGUAACCAAGUdTdT | ACUUGGUUACCUAUCUCUG | 3198 |
| AD-887392 | A-1684058.1 | 323 | CUUGGUUACCUAUCUCUGCdTdT | A-1684059.1 | 324 | GCAGAGAUAGGUAACCAAGdTdT | CUUGGUUACCUAUCUCUGC | 3199 |
| AD-887393 | A-1684060.1 | 325 | GGUUACCUAUCUCUGCUUCdTdT | A-1684061.1 | 326 | GAAGCAGAGAUAGGUAACCdTdT | GGUUACCUAUCUCUGCUUC | 3200 |
| AD-887394 | A-1684062.1 | 327 | GUUACCUAUCUCUGCUUCAdTdT | A-1684063.1 | 328 | UGAAGCAGAGAUAGGUAACdTdT | GUUACCUAUCUCUGCUUCA | 3201 |
| AD-887395 | A-1684064.1 | 329 | UUACCUAUCUCUGCUUCAAdTdT | A-1684065.1 | 330 | UUGAAGCAGAGAUAGGUAAdTdT | UUACCUAUCUCUGCUUCAA | 3202 |
| AD-887396 | A-1684066.1 | 331 | UACCUAUCUCUGCUUCAAGdTdT | A-1684067.1 | 332 | CUUGAAGCAGAGAUAGGUAdTdT | UACCUAUCUCUGCUUCAAG | 3203 |
| AD-887397 | A-1684068.1 | 333 | ACCUAUCUCUGCUUCAAGUdTdT | A-1684069.1 | 334 | ACUUGAAGCAGAGAUAGGUdTdT | ACCUAUCUCUGCUUCAAGU | 3204 |
| AD-887398 | A-1684070.1 | 335 | CCUAUCUCUGCUUCAAGUUdTdT | A-1684071.1 | 336 | AACUUGAAGCAGAGAUAGGdTdT | CCUAUCUCUGCUUCAAGUU | 3205 |
| AD-887399 | A-1684072.1 | 337 | CUAUCUCUGCUUCAAGUUGdTdT | A-1684073.1 | 338 | CAACUUGAAGCAGAGAUAGdTdT | CUAUCUCUGCUUCAAGUUG | 3206 |

TABLE 2A-continued

Exemplary Human SCN9A siRNA Modified Single Strands and Duplex Sequences
Column 1 indicates duplex name. Column 2 indicates the name of the sense sequence. Column 3 indicates the sequence ID for the sequence of column 4. Column 4 provides the modified sequence of a sense strand suitable for use in a duplex described herein. Column 5 indicates the antisense sequence name. Column 6 indicates the sequence ID for the sequence of column 7. Column 7 provides the sequence of a modified antisense strand suitable for use in a duplex described herein, e.g., a duplex comprising the sense sequence in the same row of the table. Column 8 indicates the position in the target mRNA (NM_002977.3) that is complementary to the antisense strand of Column 7. Column9 indicated the sequence ID for the sequence of column 8.

| Duplex Name | Sense sequence name | Seq ID NO: (sense) | Sense sequence (5'-3') | Antisense sequence name | Seq ID NO: (antisense) | Antisense sequence (5'-3') | mRNA target sequence in NM_002977.3 | Seq ID NO: (mRNA target) |
|---|---|---|---|---|---|---|---|---|
| AD-887400 | A-1684074.1 | 339 | AUCUCUGCUUCAAGUUGCAdTdT | A-1684075.1 | 340 | UGCAACUUGAAGCAGAGAUdTdT | AUCUCUGCUUCAAGUUGCA | 3207 |
| AD-887401 | A-1684076.1 | 341 | UCUCUGCUUCAAGUUGCAAdTdT | A-1684077.1 | 342 | UUGCAACUUGAAGCAGAGAdTdT | UCUCUGCUUCAAGUUGCAA | 3208 |
| AD-887402 | A-1684078.1 | 343 | CUCUGCUUCAAGUUGCAACdTdT | A-1684079.1 | 344 | GUUGCAACUUGAAGCAGAGdTdT | CUCUGCUUCAAGUUGCAAC | 3209 |
| AD-887403 | A-1684080.1 | 345 | UCUGCUUCAAGUUGCAACUdTdT | A-1684081.1 | 346 | AGUUGCAACUUGAAGCAGAdTdT | UCUGCUUCAAGUUGCAACU | 3210 |
| AD-887404 | A-1684082.1 | 347 | UAUCAUCUUUGGGUCAUUCdTdT | A-1684083.1 | 348 | GAAUGACCCAAAGAUGAUAdTdT | UAUCAUCUUUGGGUCAUUC | 3211 |
| AD-887405 | A-1684084.1 | 349 | AUCAUCUUUGGGUCAUUCUdTdT | A-1684085.1 | 350 | AGAAUGACCCAAAGAUGAUdTdT | AUCAUCUUUGGGUCAUUCU | 3212 |
| AD-887406 | A-1684086.1 | 351 | UCAUCUUUGGGUCAUUCUUdTdT | A-1684087.1 | 352 | AAGAAUGACCCAAAGAUGAdTdT | UCAUCUUUGGGUCAUUCUU | 3213 |
| AD-887407 | A-1684088.1 | 353 | CAUCUUUGGGUCAUUCUUCdTdT | A-1684089.1 | 354 | GAAGAAUGACCCAAAGAUGdTdT | CAUCUUUGGGUCAUUCUUC | 3214 |
| AD-887408 | A-1684090.1 | 355 | CUUUGGGUCAUUCUUCACUdTdT | A-1684091.1 | 356 | AGUGAAGAAUGACCCAAAGdTdT | CUUUGGGUCAUUCUUCACU | 3215 |
| AD-887409 | A-1684092.1 | 357 | UUGGGUCAUUCUUCACUUUdTdT | A-1684093.1 | 358 | AAAGUGAAGAAUGACCCAAdTdT | UUGGGUCAUUCUUCACUUU | 3216 |

TABLE 2A-continued

Exemplary Human SCN9A siRNA Modified Single Strands and Duplex Sequences
Column 1 indicates duplex name. Column 2 indicates the name of the sense sequence. Column 3 indicates the sequence ID for the sequence of column 4. Column 4 provides the modified sequence of a sense strand suitable for use in a duplex described herein. Column 5 indicates the antisense sequence name. Column 6 indicates the sequence ID for the sequence of column 7. Column 7 provides the sequence of a modified antisense strand suitable for use in a duplex described herein, e.g., a duplex comprising the sense sequence in the same row of the table. Column 8 indicates the position in the target mRNA (NM_002977.3) that is complementary to the antisense strand of Column 7. Column9 indicated the sequence ID for the sequence of column 8.

| Duplex Name | Sense sequence name | Seq ID NO: (sense) | Sense sequence (5'-3') | Antisense sequence name | Seq ID NO: (antisense) | Antisense sequence (5'-3') | mRNA target sequence in NM_002977.3 | Seq ID NO: (mRNA target) |
|---|---|---|---|---|---|---|---|---|
| AD-887410 | A-1684094.1 | 359 | UGGGUCAUUCUUCACUUUGdTdT | A-1684095.1 | 360 | CAAAGUGAAGAAUGACCCAdTdT | UGGGUCAUUCUUCACUUUG | 3217 |
| AD-887411 | A-1684096.1 | 361 | GGGUCAUUCUUCACUUUGAdTdT | A-1684097.1 | 362 | UCAAAGUGAAGAAUGACCCdTdT | GGGUCAUUCUUCACUUUGA | 3218 |
| AD-887412 | A-1684098.1 | 363 | GGUCAUUCUUCACUUUGAAdTdT | A-1684099.1 | 364 | UUCAAAGUGAAGAAUGACCdTdT | GGUCAUUCUUCACUUUGAA | 3219 |
| AD-887413 | A-1684100.1 | 365 | GUCAUUCUUCACUUUGAACdTdT | A-1684101.1 | 366 | GUUCAAAGUGAAGAAUGACdTdT | GUCAUUCUUCACUUUGAAC | 3220 |
| AD-887414 | A-1684102.1 | 367 | CAUUCUUCACUUUGAACUUdTdT | A-1684103.1 | 368 | AAGUUCAAAGUGAAGAAUGdTdT | CAUUCUUCACUUUGAACUU | 3221 |
| AD-887415 | A-1684104.1 | 369 | UCACUUUGAACUUGUUCAUdTdT | A-1684105.1 | 370 | AUGAACAAGUUCAAAGUGAdTdT | UCACUUUGAACUUGUUCAU | 3222 |
| AD-887416 | A-1684106.1 | 371 | CUUGUUCAUUGGUGUCAUCdTdT | A-1684107.1 | 372 | GAUGACACCAAUGAACAAGdTdT | CUUGUUCAUUGGUGUCAUC | 3223 |
| AD-887417 | A-1684108.1 | 373 | GUGUCAUCAUAGAUAAUUUdTdT | A-1684109.1 | 374 | AAAUUAUCUAUGAUGACACdTdT | GUGUCAUCAUAGAUAAUUU | 3224 |
| AD-887418 | A-1684110.1 | 375 | UGUCAUCAUAGAUAAUUUCdTdT | A-1684111.1 | 376 | GAAAUUAUCUAUGAUGACAdTdT | UGUCAUCAUAGAUAAUUUC | 3225 |
| AD-887419 | A-1684112.1 | 377 | GAGGUCAAGACAUCUUUAUdTdT | A-1684113.1 | 378 | AUAAAGAUGUCUUGACCUCdTdT | GAGGUCAAGACAUCUUUAU | 3226 |

TABLE 2A-continued

Exemplary Human SCN9A siRNA Modified Single Strands and Duplex Sequences
Column 1 indicates duplex name. Column 2 indicates the name of the sense sequence. Column 3 indicates the sequence ID for the sequence of column 4. Column 4 provides the modified sequence of a sense strand suitable for use in a duplex described herein. Column 5 indicates the antisense sequence name. Column 6 indicates the sequence ID for the sequence of column 7. Column 7 provides the sequence of a modified antisense strand suitable for use in a duplex described herein, e.g., a duplex comprising the sense sequence in the same row of the table. Column 8 indicates the position in the target mRNA (NM_002977.3) that is complementary to the antisense strand of Column 7. Column9 indicated the sequence ID for the sequence of column 8.

| Duplex Name | Sense sequence name | Seq ID NO: (sense) | Sense sequence (5'-3') | Antisense sequence name | Seq ID NO: (antisense) | Antisense sequence (5'-3') | mRNA target sequence in NM_002977.3 | Seq ID NO: (mRNA target) |
|---|---|---|---|---|---|---|---|---|
| AD-887420 | A-1684114.1 | 379 | AGGUCAAGACAUCUUUAUGdTdT | A-1684115.1 | 380 | CAUAAAGAUGUCUUGACCUdTdT | AGGUCAAGACAUCUUUAUG | 3227 |
| AD-887421 | A-1684116.1 | 381 | GGUCAAGACAUCUUUAUGAdTdT | A-1684117.1 | 382 | UCAUAAAGAUGUCUUGACCdTdT | GGUCAAGACAUCUUUAUGA | 3228 |
| AD-887422 | A-1684118.1 | 383 | CCACAAAAGCCAAUUCCUCdTdT | A-1684119.1 | 384 | GAGGAAUUGGCUUUUGUGGdTdT | CCACAAAAGCCAAUUCcue | 3229 |
| AD-887423 | A-1684120.1 | 385 | GACCUAGUGACAAAUCAAGdTdT | A-1684121.1 | 386 | CUUGAUUUGUCACUAGGUCdTdT | GACCUAGUGACAAAUCAAG | 3230 |
| AD-887424 | A-1684122.1 | 387 | GUAUCAUGGUUCUUAUCUGdTdT | A-1684123.1 | 388 | CAGAUAAGAACCAUGAUACdTdT | GUAUCAUGGUUCUUAUCUG | 3231 |
| AD-887425 | A-1684124.1 | 389 | UAUCAUGGUUCUUAUCUGUdTdT | A-1684125.1 | 390 | ACAGAUAAGAACCAUGAUAdTdT | UAUCAUGGUUCUUAUCUGU | 3232 |
| AD-887426 | A-1684126.1 | 391 | UCAUGGUUCUUAUCUGUCUdTdT | A-1684127.1 | 392 | AGACAGAUAAGAACCAUGAdTdT | UCAUGGUUCUUAUCUGUCU | 3233 |
| AD-887427 | A-1684128.1 | 393 | CAUGGUUCUUAUCUGUCUCdTdT | A-1684129.1 | 394 | GAGACAGAUAAGAACCAUGdTdT | CAUGGUUCUUAUCUGUCUC | 3234 |
| AD-887428 | A-1684130.1 | 395 | AUGGUUCUUAUCUGUCUCAdTdT | A-1684131.1 | 396 | UGAGACAGAUAAGAACCAUdTdT | AUGGUUCUUAUCUGUCUCA | 3235 |
| AD-887429 | A-1684132.1 | 397 | UGGUUCUUAUCUGUCUCAAdTdT | A-1684133.1 | 398 | UUGAGACAGAUAAGAACCAdTdT | UGGUUCUUAUCUGUCUCAA | 3236 |

TABLE 2A-continued

Exemplary Human SCN9A siRNA Modified Single Strands and Duplex Sequences
Column 1 indicates duplex name. Column 2 indicates the name of the sense sequence. Column 3 indicates the sequence ID for the sequence of column 4. Column 4 provides the modified sequence of a sense strand suitable for use in a duplex described herein. Column 5 indicates the antisense sequence name. Column 6 indicates the sequence ID for the sequence of column 7. Column 7 provides the sequence of a modified antisense strand suitable for use in a duplex described herein, e.g., a duplex comprising the sense sequence in the same row of the table. Column 8 indicates the position in the target mRNA (NM_002977.3) that is complementary to the antisense strand of Column 7. Column9 indicated the sequence ID for the sequence of column 8.

| Duplex Name | Sense sequence name | Seq ID NO: (sense) | Sense sequence (5'-3') | Antisense sequence name | Seq ID NO: (antisense) | Antisense sequence (5'-3') | mRNA target sequence in NM_002977.3 | Seq ID NO: (mRNA target) |
|---|---|---|---|---|---|---|---|---|
| AD-887430 | A-1684134.1 | 399 | GGUUCUUAUCUGUCUCAACdTdT | A-1684135.1 | 400 | GUUGAGACAGAUAAGAACCdTdT | GGUUCUUAUCUGUCUCAAC | 3237 |
| AD-887431 | A-1684136.1 | 401 | GUUCUUAUCUGUCUCAACAdTdT | A-1684137.1 | 402 | UGUUGAGACAGAUAAGAACdTdT | GUUCUUAUCUGUCUCAACA | 3238 |
| AD-887432 | A-1684138.1 | 403 | UCUUAUCUGUCUCAACAUGdTdT | A-1684139.1 | 404 | CAUGUUGAGACAGAUAAGAdTdT | UCUUAUCUGUCUCAACAUG | 3239 |
| AD-887433 | A-1684140.1 | 405 | AUCUGUCUCAACAUGGUAAdTdT | A-1684141.1 | 406 | UUACCAUGUUGAGACAGAUdTdT | AUCUGUCUCAACAUGGUAA | 3240 |
| AD-887434 | A-1684142.1 | 407 | UCUGUCUCAACAUGGUAACdTdT | A-1684143.1 | 408 | GUUACCAUGUUGAGACAGAdTdT | UCUGUCUCAACAUGGUAAC | 3241 |
| AD-887435 | A-1684144.1 | 409 | CUGUCUCAACAUGGUAACCdTdT | A-1684145.1 | 410 | GGUUACCAUGUUGAGACAGdTdT | CUGUCUCAACAUGGUAACC | 3242 |
| AD-887436 | A-1684146.1 | 411 | UCCUGGUCAUGUUCAUCUAdTdT | A-1684147.1 | 412 | UAGAUGAACAUGACCAGGAdTdT | UCCUGGUCAUGUUCAUCUA | 3243 |
| AD-887437 | A-1684148.1 | 413 | AGUUCAUCCUGGAAGUUCAdTdT | A-1684149.1 | 414 | UGAACUUCCAGGAUGAACUdTdT | AGUUCAUCCUGGAAGUUCA | 3244 |
| AD-887438 | A-1684150.1 | 415 | CCAUCUGUUGGAAUAUUCUdTdT | A-1684151.1 | 416 | AGAAUAUUCCAACAGAUGGdTdT | CCAUCUGUUGGAAUAUUCU | 3245 |
| AD-887439 | A-1684152.1 | 417 | CAUCUGUUGGAAUAUUCUAdTdT | A-1684153.1 | 418 | UAGAAUAUUCCAACAGAUGdTdT | CAUCUGUUGGAAUAUUCUA | 3246 |

TABLE 2A-continued

Exemplary Human SCN9A siRNA Modified Single Strands and Duplex Sequences
Column 1 indicates duplex name. Column 2 indicates the name of the sense sequence. Column 3 indicates the sequence ID for the sequence of column 4. Column 4 provides the modified sequence of a sense strand suitable for use in a duplex described herein. Column 5 indicates the antisense sequence name. Column 6 indicates the sequence ID for the sequence of column 7. Column 7 provides the sequence of a modified antisense strand suitable for use in a duplex described herein, e.g., a duplex comprising the sense sequence in the same row of the table. Column 8 indicates the position in the target mRNA (NM_002977.3) that is complementary to the antisense strand of Column 7. Column9 indicated the sequence ID for the sequence of column 8.

| Duplex Name | Sense sequence name | Seq ID NO: (sense) | Sense sequence (5'-3') | Antisense sequence name | Seq ID NO: (antisense) | Antisense sequence (5'-3') | mRNA target sequence in NM_002977.3 | Seq ID NO: (mRNA target) |
|---|---|---|---|---|---|---|---|---|
| AD-887440 | A-1684154.1 | 419 | UCUGUUGGAAUAUUCUACUdTdT | A-1684155.1 | 420 | AGUAGAAUAUUCCAACAGAdTdT | UCUGUUGGAAUAUUCUACU | 3247 |
| AD-887441 | A-1684156.1 | 421 | CAUACUGGAGAAUUUUAGUdTdT | A-1684157.1 | 422 | ACUAAAAUUCUCCAGUAUGdTdT | CAUACUGGAGAAUUUUAGU | 3248 |
| AD-887442 | A-1684158.1 | 423 | CUCCUCUUCUCAUAGCAAAdTdT | A-1684159.1 | 424 | UUUGCUAUGAGAAGAGGAGdTdT | CUCCUCUUCUCAUAGCAAA | 3249 |
| AD-887443 | A-1684160.1 | 425 | UCCUCUUCUCAUAGCAAAAdTdT | A-1684161.1 | 426 | UUUUGCUAUGAGAAGAGGAdTdT | UCCUCUUCUCAUAGCAAAA | 3250 |
| AD-887444 | A-1684162.1 | 427 | CCUCUUCUCAUAGCAAAACdTdT | A-1684163.1 | 428 | GUUUUGCUAUGAGAAGAGGdTdT | CCUCUUCUCAUAGCAAAAC | 3251 |
| AD-887445 | A-1684164.1 | 429 | CUCUUCUCAUAGCAAAACCdTdT | A-1684165.1 | 430 | GGUUUUGCUAUGAGAAGAGdTdT | CUCUUCUCAUAGCAAAACC | 3252 |
| AD-887446 | A-1684166.1 | 431 | GAUCCAUUGUCUUGACAUCdTdT | A-1684167.1 | 432 | GAUGUCAAGACAAUGGAUCdTdT | GAUCCAUUGUCUUGACAUC | 3253 |
| AD-887447 | A-1684168.1 | 433 | AUCCAUUGUCUUGACAUCUdTdT | A-1684169.1 | 434 | AGAUGUCAAGACAAUGGAUdTdT | AUCCAUUGUCUUGACAUCU | 3254 |
| AD-887448 | A-1684170.1 | 435 | UCCAUUGUCUUGACAUCUUdTdT | A-1684171.1 | 436 | AAGAUGUCAAGACAAUGGAdTdT | UCCAUUGUCUUGACAUCUU | 3255 |
| AD-887449 | A-1684172.1 | 437 | CAUUGUCUUGACAUCUUAUdTdT | A-1684173.1 | 438 | AUAAGAUGUCAAGACAAUGdTdT | CAUUGUCUUGACAUCUUAU | 3256 |

TABLE 2A-continued

Exemplary Human SCN9A siRNA Modified Single Strands and Duplex Sequences
Column 1 indicates duplex name. Column 2 indicates the name of the sense sequence. Column 3 indicates the sequence ID for the sequence of column 4. Column 4 provides the modified sequence of a sense strand suitable for use in a duplex described herein. Column 5 indicates the antisense sequence name. Column 6 indicates the sequence ID for the sequence of column 7. Column 7 provides the sequence of a modified antisense strand suitable for use in a duplex described herein, e.g., a duplex comprising the sense sequence in the same row of the table. Column 8 indicates the position in the target mRNA (NM_002977.3) that is complementary to the antisense strand of Column 7. Column9 indicated the sequence ID for the sequence of column 8.

| Duplex Name | Sense sequence name | Seq ID NO: (sense) | Sense sequence (5'-3') | Antisense sequence name | Seq ID NO: (antisense) | Antisense sequence (5'-3') | mRNA target sequence in NM_002977.3 | Seq ID NO: (mRNA target) |
|---|---|---|---|---|---|---|---|---|
| AD-887450 | A-1684174.1 | 439 | UUGUCUUGACAUCUUAUUUdTdT | A-1684175.1 | 440 | AAAUAAGAUGUCAAGACAAdTdT | UUGUCUUGACAUCUUAUUU | 3257 |
| AD-887451 | A-1684176.1 | 441 | UGUCUUGACAUCUUAUUUGdTdT | A-1684177.1 | 442 | CAAAUAAGAUGUCAAGACAdTdT | UGUCUUGACAUCUUAUUUG | 3258 |
| AD-887452 | A-1684178.1 | 443 | GUCUUGACAUCUUAUUUGCdTdT | A-1684179.1 | 444 | GCAAAUAAGAUGUCAAGACdTdT | GUCUUGACAUCUUAUUUGC | 3259 |
| AD-887453 | A-1684180.1 | 445 | GGAGAUGGAUUCUCUUCGUdTdT | A-1684181.1 | 446 | ACGAAGAGAAUCCAUCUCCdTdT | GGAGAUGGAUUCUCUUCGU | 3260 |
| AD-887454 | A-1684182.1 | 447 | GAGAUGGAUUCUCUUCGUUdTdT | A-1684183.1 | 448 | AACGAAGAGAAUCCAUCUCdTdT | GAGAUGGAUUCUCUUCGUU | 3261 |
| AD-887455 | A-1684184.1 | 449 | AGAUGGAUUCUCUUCGUUCdTdT | A-1684185.1 | 450 | GAACGAAGAGAAUCCAUCUdTdT | AGAUGGAUUCUCUUCGUUC | 3262 |
| AD-887456 | A-1684186.1 | 451 | GAUGGAUUCUCUUCGUUCAdTdT | A-1684187.1 | 452 | UGAACGAAGAGAAUCCAUCdTdT | GAUGGAUUCUCUUCGUUCA | 3263 |
| AD-887457 | A-1684188.1 | 453 | AUGGAUUCUCUUCGUUCACdTdT | A-1684189.1 | 454 | GUGAACGAAGAGAAUCCAUdTdT | AUGGAUUCUCUUCGUUCAC | 3264 |
| AD-887458 | A-1684190.1 | 455 | UGGAUUCUCUUCGUUCACAdTdT | A-1684191.1 | 456 | UGUGAACGAAGAGAAUCCAdTdT | UGGAUUCUCUUCGUUCACA | 3265 |
| AD-887459 | A-1684192.1 | 457 | GGAUUCUCUUCGUUCACAGdTdT | A-1684193.1 | 458 | CUGUGAACGAAGAGAAUCCdTdT | GGAUUCUCUUCGUUCACAG | 3266 |

TABLE 2A-continued

Exemplary Human SCN9A siRNA Modified Single Strands and Duplex Sequences
Column 1 indicates duplex name. Column 2 indicates the name of the sense sequence. Column 3 indicates the sequence ID for the sequence of column 4. Column 4 provides the modified sequence of a sense strand suitable for use in a duplex described herein. Column 5 indicates the antisense sequence name. Column 6 indicates the sequence ID for the sequence of column 7. Column 7 provides the sequence of a modified antisense strand suitable for use in a duplex described herein, e.g., a duplex comprising the sense sequence in the same row of the table. Column 8 indicates the position in the target mRNA (NM_002977.3) that is complementary to the antisense strand of Column 7. Column9 indicated the sequence ID for the sequence of column 8.

| Duplex Name | Sense sequence name | Seq ID NO: (sense) | Sense sequence (5'-3') | Antisense sequence name | Seq ID NO: (antisense) | Antisense sequence (5'-3') | mRNA target sequence in NM_002977.3 | Seq ID NO: (mRNA target) |
|---|---|---|---|---|---|---|---|---|
| AD-887460 | A-1684194.1 | 459 | GAUUCUCUUCGUUCACAGAdTdT | A-1684195.1 | 460 | UCUGUGAACGAAGAGAAUCdTdT | GAUUCUCUUCGUUCACAGA | 3267 |
| AD-887461 | A-1684196.1 | 461 | UUCUCUUCGUUCACAGAUGdTdT | A-1684197.1 | 462 | CAUCUGUGAACGAAGAGAAdTdT | UUCUCUUCGUUCACAGAUG | 3268 |
| AD-887462 | A-1684198.1 | 463 | UCUCUUCGUUCACAGAUGGdTdT | A-1684199.1 | 464 | CCAUCUGUGAACGAAGAGAdTdT | UCUCUUCGUUCACAGAUGG | 3269 |
| AD-887463 | A-1684200.1 | 465 | CUCUUCGUUCACAGAUGGAdTdT | A-1684201.1 | 466 | UCCAUCUGUGAACGAAGAGdTdT | CUCUUCGUUCACAGAUGGA | 3270 |
| AD-887464 | A-1684202.1 | 467 | UCUUCGUUCACAGAUGGAAdTdT | A-1684203.1 | 468 | UUCCAUCUGUGAACGAAGAdTdT | UCUUCGUUCACAGAUGGAA | 3271 |
| AD-887465 | A-1684204.1 | 469 | AGGUUCAUGUCUGCAAAUCdTdT | A-1684205.1 | 470 | GAUUUGCAGACAUGAACCUdTdT | AGGUUCAUGUCUGCAAAUC | 3272 |
| AD-887466 | A-1684206.1 | 471 | UCUGCAAAUCCUUCCAAAGdTdT | A-1684207.1 | 472 | CUUUGGAAGGAUUUGCAGAdTdT | UCUGCAAAUCCUUCCAAAG | 3273 |
| AD-887467 | A-1684208.1 | 473 | CUGCAAAUCCUUCCAAAGUdTdT | A-1684209.1 | 474 | ACUUUGGAAGGAUUUGCAGdTdT | CUGCAAAUCCUUCCAAAGU | 3274 |
| AD-887468 | A-1684210.1 | 475 | GUGUCUGCUACUGUCAUUCdTdT | A-1684211.1 | 476 | GAAUGACAGUAGCAGACACdTdT | GUGUCUGCUACUGUCAUUC | 3275 |
| AD-887469 | A-1684212.1 | 477 | UGUCUGCUACUGUCAUUCAdTdT | A-1684213.1 | 478 | UGAAUGACAGUAGCAGACAdTdT | UGUCUGCUACUGUCAUUCA | 3276 |

TABLE 2A-continued

Exemplary Human SCN9A siRNA Modified Single Strands and Duplex Sequences
Column 1 indicates duplex name. Column 2 indicates the name of the sense sequence. Column 3 indicates the sequence ID for the sequence of column 4. Column 4 provides the modified sequence of a sense strand suitable for use in a duplex described herein. Column 5 indicates the antisense sequence name. Column 6 indicates the sequence ID for the sequence of column 7. Column 7 provides the sequence of a modified antisense strand suitable for use in a duplex described herein, e.g., a duplex comprising the sense sequence in the same row of the table. Column 8 indicates the position in the target mRNA (NM_002977.3) that is complementary to the antisense strand of Column 7. Column9 indicated the sequence ID for the sequence of column 8.

| Duplex Name | Sense sequence name | Seq ID NO: (sense) | Sense sequence (5'-3') | Antisense sequence name | Seq ID NO: (antisense) | Antisense sequence (5'-3') | mRNA target sequence in NM_002977.3 | Seq ID NO: (mRNA target) |
|---|---|---|---|---|---|---|---|---|
| AD-887470 | A-1684214.1 | 479 | GUCUGCUACUGUCAUUCAGdTdT | A-1684215.1 | 480 | CUGAAUGACAGUAGCAGACdTdT | GUCUGCUACUGUCAUUCAG | 3277 |
| AD-887471 | A-1684216.1 | 481 | ACCGCUUAAGGCAAAAUGUdTdT | A-1684217.1 | 482 | ACAUUUUGCCUUAAGCGGUdTdT | ACCGCUUAAGGCAAAAUGU | 3278 |
| AD-887472 | A-1684218.1 | 483 | CCGCUUAAGGCAAAAUGUCdTdT | A-1684219.1 | 484 | GACAUUUUGCCUUAAGCGGdTdT | CCGCUUAAGGCAAAAUGUC | 3279 |
| AD-887473 | A-1684220.1 | 485 | UCUCCACCUUCAUAUGAUAdTdT | A-1684221.1 | 486 | UAUCAUAUGAAGGUGGAGAdTdT | UCUCCACCUUCAUAUGAUA | 3280 |
| AD-887474 | A-1684222.1 | 487 | UGCCAAAAUCCUUUUUAUCdTdT | A-1684223.1 | 488 | GAUAAAAAGGAUUUUGGCAdTdT | UGCCAAAAUCCUUUUUAUC | 3281 |
| AD-887475 | A-1684224.1 | 489 | GCCAAAAUCCUUUUUAUCAdTdT | A-1684225.1 | 490 | UGAUAAAAAGGAUUUUGGCdTdT | GCCAAAAUCCUUUUUAUCA | 3282 |
| AD-887476 | A-1684226.1 | 491 | UCGUAAGAGAACUCUGUAGdTdT | A-1684227.1 | 492 | CUACAGAGUUCUCUUACGAdTdT | UCGUAAGAGAACUCUGUAG | 3283 |
| AD-887477 | A-1684228.1 | 493 | UCUGCCUUGUCAUCUUUUCdTdT | A-1684229.1 | 494 | GAAAAGAUGACAAGGCAGAdTdT | UCUGCCUUGUCAUCUUUUC | 3284 |
| AD-887478 | A-1684230.1 | 495 | CUGCCUUGUCAUCUUUUCAdTdT | A-1684231.1 | 496 | UGAAAAGAUGACAAGGCAGdTdT | CUGCCUUGUCAUCUUUUCA | 3285 |
| AD-887479 | A-1684232.1 | 497 | UGCCUUGUCAUCUUUUCACdTdT | A-1684233.1 | 498 | GUGAAAAGAUGACAAGGCAdTdT | UGCCUUGUCAUCUUUUCAC | 3286 |

TABLE 2A-continued

Exemplary Human SCN9A siRNA Modified Single Strands and Duplex Sequences
Column 1 indicates duplex name. Column 2 indicates the name of the sense sequence. Column 3 indicates the sequence ID for the sequence of column 4. Column 4 provides the modified sequence of a sense strand suitable for use in a duplex described herein. Column 5 indicates the antisense sequence name. Column 6 indicates the sequence ID for the sequence of column 7. Column 7 provides the sequence of a modified antisense strand suitable for use in a duplex described herein, e.g., a duplex comprising the sense sequence in the same row of the table. Column 8 indicates the position in the target mRNA (NM_002977.3) that is complementary to the antisense strand of Column 7. Column9 indicated the sequence ID for the sequence of column 8.

| Duplex Name | Sense sequence name | Seq ID NO: (sense) | Sense sequence (5'-3') | Antisense sequence name | Seq ID NO: (antisense) | Antisense sequence (5'-3') | mRNA target sequence in NM_002977.3 | Seq ID NO: (mRNA target) |
|---|---|---|---|---|---|---|---|---|
| AD-887480 | A-1684234.1 | 499 | GCCUUGUCAUCUUUUCACAdTdT | A-1684235.1 | 500 | UGUGAAAAGAUGACAAGGCdTdT | GCCUUGUCAUCUUUUCACA | 3287 |
| AD-887481 | A-1684236.1 | 501 | CCUUGUCAUCUUUUCACAGdTdT | A-1684237.1 | 502 | CUGUGAAAAGAUGACAAGGdTdT | CCUUGUCAUCUUUUCACAG | 3288 |
| AD-887482 | A-1684238.1 | 503 | CAUCUUUUCACAGGAUUGUdTdT | A-1684239.1 | 504 | ACAAUCCUGUGAAAAGAUGdTdT | CAUCUUUUCACAGGAUUGU | 3289 |
| AD-887483 | A-1684240.1 | 505 | CCCAUGUAAAUAAACAACAdTdT | A-1684241.1 | 506 | UGUUGUUUAUUUACAUGGGdTdT | CCCAUGUAAAUAAACAACA | 3290 |
| AD-887484 | A-1684242.1 | 507 | CAUUCAUCUUGACUCACAUdTdT | A-1684243.1 | 508 | AUGUGAGUCAAGAUGAAUGdTdT | CAUUCAUCUUGACUCACAU | 3291 |
| AD-887485 | A-1684244.1 | 509 | ACAUAUUACACUCCUCAAAdTdT | A-1684245.1 | 510 | UUUGAGGAGUGUAAUAUGUdTdT | ACAUAUUACACUCCUCAAA | 3292 |
| AD-887486 | A-1684246.1 | 511 | CAUAUUACACUCCUCAAAAdTdT | A-1684247.1 | 512 | UUUUGAGGAGUGUAAUAUGdTdT | CAUAUUACACUCCUCAAAA | 3293 |
| AD-887487 | A-1684248.1 | 513 | UGCCCAAAAUACUGAUAAUdTdT | A-1684249.1 | 514 | AUUAUCAGUAUUUUGGGCAdTdT | UGCCCAAAAUACUGAUAAU | 3294 |
| AD-887488 | A-1684250.1 | 515 | GCCCAAAAUACUGAUAAUAdTdT | A-1684251.1 | 516 | UAUUAUCAGUAUUUUGGGCdTdT | GCCCAAAAUACUGAUAAUA | 3295 |
| AD-887489 | A-1684252.1 | 517 | CUGAUAAUAGUCUCUUAAAdTdT | A-1684253.1 | 518 | UUUAAGAGACUAUUAUCAGdTdT | CUGAUAAUAGUCUCUUAAA | 3296 |

TABLE 2A-continued

Exemplary Human SCN9A siRNA Modified Single Strands and Duplex Sequences
Column 1 indicates duplex name. Column 2 indicates the name of the sense sequence. Column 3 indicates the sequence ID for the sequence of column 4. Column 4 provides the modified sequence of a sense strand suitable for use in a duplex described herein. Column 5 indicates the antisense sequence name. Column 6 indicates the sequence ID for the sequence of column 7. Column 7 provides the sequence of a modified antisense strand suitable for use in a duplex described herein, e.g., a duplex comprising the sense sequence in the same row of the table. Column 8 indicates the position in the target mRNA (NM_002977.3) that is complementary to the antisense strand of Column 7. Column9 indicated the sequence ID for the sequence of column 8.

| Duplex Name | Sense sequence name | Seq ID NO: (sense) | Sense sequence (5'-3') | Antisense sequence name | Seq ID NO: (antisense) | Antisense sequence (5'-3') | mRNA target sequence in NM_002977.3 | Seq ID NO: (mRNA target) |
|---|---|---|---|---|---|---|---|---|
| AD-887490 | A-1684254.1 | 519 | GUCAAAUUUUCCUGCUUUCdTdT | A-1684255.1 | 520 | GAAAGCAGGAAAAUUUGACdTdT | GUCAAAUUUUCCUGCUUUC | 3297 |
| AD-887491 | A-1684256.1 | 521 | UCAAAUUUUCCUGCUUUCUdTdT | A-1684257.1 | 522 | AGAAAGCAGGAAAAUUUGAdTdT | UCAAAUUUUCCUGCUUUCU | 3298 |
| AD-887492 | A-1684258.1 | 523 | CAAAUUUUCCUGCUUUCUUdTdT | A-1684259.1 | 524 | AAGAAAGCAGGAAAAUUUGdTdT | CAAAUUUUCCUGCUUUCUU | 3299 |
| AD-887493 | A-1684260.1 | 525 | AUUGUUUAGUCAUCCUUUCdTdT | A-1684261.1 | 526 | GAAAGGAUGACUAAACAAUdTdT | AUUGUUUAGUCAUCCUUUC | 3300 |
| AD-887494 | A-1684262.1 | 527 | GCAUCACUUGUAUACAAUCdTdT | A-1684263.1 | 528 | GAUUGUAUACAAGUGAUGCdTdT | GCAUCACUUGUAUACAAUC | 3301 |
| AD-887495 | A-1684264.1 | 529 | CACCAACUUACUUUCCUAAdTdT | A-1684265.1 | 530 | UUAGGAAAGUAAGUUGGUGdTdT | CACCAACUUACUUUCCUAA | 3302 |
| AD-887496 | A-1684266.1 | 531 | ACCAACUUACUUUCCUAAAdTdT | A-1684267.1 | 532 | UUUAGGAAAGUAAGUUGGUdTdT | ACCAACUUACUUUCCUAAA | 3303 |
| AD-887497 | A-1684268.1 | 533 | CCAACUUACUUUCCUAAAUdTdT | A-1684269.1 | 534 | AUUUAGGAAAGUAAGUUGGdTdT | CCAACUUACUUUCCUAAAU | 3304 |
| AD-887498 | A-1684270.1 | 535 | CAACUUACUUUCCUAAAUUdTdT | A-1684271.1 | 536 | AAUUUAGGAAAGUAAGUUGdTdT | CAACUUACUUUCCUAAAUU | 3305 |
| AD-887499 | A-1684272.1 | 537 | AGGAAGAUGUCACCUUCUCdTdT | A-1684273.1 | 538 | GAGAAGGUGACAUCUUCCUdTdT | AGGAAGAUGUCACCUUCUC | 3306 |

TABLE 2A-continued

Exemplary Human SCN9A siRNA Modified Single Strands and Duplex Sequences
Column 1 indicates duplex name. Column 2 indicates the name of the sense sequence. Column 3 indicates the sequence ID for the sequence of column 4. Column 4 provides the modified sequence of a sense strand suitable for use in a duplex described herein. Column 5 indicates the antisense sequence name. Column 6 indicates the sequence ID for the sequence of column 7. Column 7 provides the sequence of a modified antisense strand suitable for use in a duplex described herein, e.g., a duplex comprising the sense sequence in the same row of the table. Column 8 indicates the position in the target mRNA (NM_002977.3) that is complementary to the antisense strand of Column 7. Column9 indicated the sequence ID for the sequence of column 8.

| Duplex Name | Sense sequence name | Seq ID NO: (sense) | Sense sequence (5'-3') | Antisense sequence name | Seq ID NO: (antisense) | Antisense sequence (5'-3') | mRNA target sequence in NM_002977.3 | Seq ID NO: (mRNA target) |
|---|---|---|---|---|---|---|---|---|
| AD-887500 | A-1684274.1 | 539 | GAAGAUGUCACCUUCUCCUdTdT | A-1684275.1 | 540 | AGGAGAAGGUGACAUCUUCdTdT | GAAGAUGUCACCUUCUCCU | 3307 |
| AD-887501 | A-1684276.1 | 541 | AGAUGUCACCUUCUCCUUAdTdT | A-1684277.1 | 542 | UAAGGAGAAGGUGACAUCUdTdT | AGAUGUCACCUUCUCCUUA | 3308 |
| AD-887502 | A-1684278.1 | 543 | GAUGUCACCUUCUCCUUAAdTdT | A-1684279.1 | 544 | UUAAGGAGAAGGUGACAUCdTdT | GAUGUCACCUUCUCCUUAA | 3309 |
| AD-887503 | A-1684280.1 | 545 | AUGUCACCUUCUCCUUAAAdTdT | A-1684281.1 | 546 | UUUAAGGAGAAGGUGACAUdTdT | AUGUCACCUUCUCCUUAAA | 3310 |
| AD-887504 | A-1684282.1 | 547 | UGUCACCUUCUCCUUAAAAdTdT | A-1684283.1 | 548 | UUUUAAGGAGAAGGUGACAdTdT | UGUCACCUUCUCCUUAAAA | 3311 |
| AD-887505 | A-1684284.1 | 549 | GUCACCUUCUCCUUAAAAUdTdT | A-1684285.1 | 550 | AUUUUAAGGAGAAGGUGACdTdT | GUCACCUUCUCCUUAAAAU | 3312 |
| AD-887506 | A-1684286.1 | 551 | UCACCUUCUCCUUAAAAUUdTdT | A-1684287.1 | 552 | AAUUUUAAGGAGAAGGUGAdTdT | UCACCUUCUCCUUAAAAUU | 3313 |
| AD-887507 | A-1684288.1 | 553 | ACCUUCUCCUUAAAAUUCUdTdT | A-1684289.1 | 554 | AGAAUUUUAAGGAGAAGGUdTdT | ACCUUCUCCUUAAAAUUCU | 3314 |
| AD-887508 | A-1684290.1 | 555 | CCUUCUCCUUAAAAUUCUAdTdT | A-1684291.1 | 556 | UAGAAUUUUAAGGAGAAGGdTdT | CCUUCUCCUUAAAAUUCUA | 3315 |
| AD-887509 | A-1684292.1 | 557 | CUUCUCCUUAAAAUUCUAUdTdT | A-1684293.1 | 558 | AUAGAAUUUUAAGGAGAAGdTdT | CUUCUCCUUAAAAUUCUAU | 3316 |

TABLE 2A-continued

Exemplary Human SCN9A siRNA Modified Single Strands and Duplex Sequences
Column 1 indicates duplex name. Column 2 indicates the name of the sense sequence. Column 3 indicates the sequence ID for the sequence of column 4. Column 4 provides the modified sequence of a sense strand suitable for use in a duplex described herein. Column 5 indicates the antisense sequence name. Column 6 indicates the sequence ID for the sequence of column 7. Column 7 provides the sequence of a modified antisense strand suitable for use in a duplex described herein, e.g., a duplex comprising the sense sequence in the same row of the table. Column 8 indicates the position in the target mRNA (NM_002977.3) that is complementary to the antisense strand of Column 7. Column9 indicated the sequence ID for the sequence of column 8.

| Duplex Name | Sense sequence name | Seq ID NO: (sense) | Sense sequence (5'-3') | Antisense sequence name | Seq ID NO: (antisense) | Antisense sequence (5'-3') | mRNA target sequence in NM_002977.3 | Seq ID NO: (mRNA target) |
|---|---|---|---|---|---|---|---|---|
| AD-887510 | A-1684294.1 | 559 | UGAGAUCUUUCUUCUAUAAdTdT | A-1684295.1 | 560 | UUAUAGAAGAAAGAUCUCAdTdT | UGAGAUCUUUCUUCUAUAA | 3317 |
| AD-887511 | A-1684296.1 | 561 | GAUCUUUCUUCUAUAAAGUdTdT | A-1684297.1 | 562 | ACUUUAUAGAAGAAAGAUCdTdT | GAUCUUUCUUCUAUAAAGU | 3318 |
| AD-887512 | A-1684298.1 | 563 | UACCAUCUUAGGUUCAUUCdTdT | A-1684299.1 | 564 | GAAUGAACCUAAGAUGGUAdTdT | UACCAUCUUAGGUUCAUUC | 3319 |
| AD-887513 | A-1684300.1 | 565 | ACCAUCUUAGGUUCAUUCAdTdT | A-1684301.1 | 566 | UGAAUGAACCUAAGAUGGUdTdT | ACCAUCUUAGGUUCAUUCA | 3320 |
| AD-887514 | A-1684302.1 | 567 | CCAUCUUAGGUUCAUUCAUdTdT | A-1684303.1 | 568 | AUGAAUGAACCUAAGAUGGdTdT | CCAUCUUAGGUUCAUUCAU | 3321 |
| AD-887515 | A-1684304.1 | 569 | CAUCUUAGGUUCAUUCAUCdTdT | A-1684305.1 | 570 | GAUGAAUGAACCUAAGAUGdTdT | CAUCUUAGGUUCAUUCAUC | 3322 |
| AD-887516 | A-1684306.1 | 571 | UCUUAGGUUCAUUCAUCUUdTdT | A-1684307.1 | 572 | AAGAUGAAUGAACCUAAGAdTdT | UCUUAGGUUCAUUCAUCUU | 3323 |
| AD-887517 | A-1684308.1 | 573 | CUUAGGUUCAUUCAUCUUAdTdT | A-1684309.1 | 574 | UAAGAUGAAUGAACCUAAGdTdT | CUUAGGUUCAUUCAUCUUA | 3324 |
| AD-887518 | A-1684310.1 | 575 | UUAGGUUCAUUCAUCUUAGdTdT | A-1684311.1 | 576 | CUAAGAUGAAUGAACCUAAdTdT | UUAGGUUCAUUCAUCUUAG | 3325 |
| AD-887519 | A-1684312.1 | 577 | UAGGUUCAUUCAUCUUAGGdTdT | A-1684313.1 | 578 | CCUAAGAUGAAUGAACCUAdTdT | UAGGUUCAUUCAUCUUAGG | 3326 |

TABLE 2A-continued

Exemplary Human SCN9A siRNA Modified Single Strands and Duplex Sequences
Column 1 indicates duplex name. Column 2 indicates the name of the sense sequence. Column 3 indicates the sequence ID for the sequence of column 4. Column 4 provides the modified sequence of a sense strand suitable for use in a duplex described herein. Column 5 indicates the antisense sequence name. Column 6 indicates the sequence ID for the sequence of column 7. Column 7 provides the sequence of a modified antisense strand suitable for use in a duplex described herein, e.g., a duplex comprising the sense sequence in the same row of the table. Column 8 indicates the position in the target mRNA (NM_002977.3) that is complementary to the antisense strand of Column 7. Column9 indicated the sequence ID for the sequence of column 8.

| Duplex Name | Sense sequence name | Seq ID NO: (sense) | Sense sequence (5'-3') | Antisense sequence name | Seq ID NO: (antisense) | Antisense sequence (5'-3') | mRNA target sequence in NM_002977.3 | Seq ID NO: (mRNA target) |
|---|---|---|---|---|---|---|---|---|
| AD-887520 | A-1684314.1 | 579 | CUGCAUUAUGAAUACUUACdTdT | A-1684315.1 | 580 | GUAAGUAUUCAUAAUGCAGdTdT | CUGCAUUAUGAAUACUUAC | 3327 |
| AD-887521 | A-1684316.1 | 581 | ACACAAUUUCUUCUUAGCAdTdT | A-1684317.1 | 582 | UGCUAAGAAGAAAUUGUGUdTdT | ACACAAUUUCUUCUUAGCA | 3328 |
| AD-887522 | A-1684318.1 | 583 | GUUCUUUUUCCUAUUUCAUdTdT | A-1684319.1 | 584 | AUGAAAUAGGAAAAAGAACdTdT | GUUCUUUUUCCUAUUUCAU | 3329 |
| AD-887523 | A-1684320.1 | 585 | UCCUAUUUCAUGAACUAUGdTdT | A-1684321.1 | 586 | CAUAGUUCAUGAAAUAGGAdTdT | UCCUAUUUCAUGAACUAUG | 3330 |
| AD-887524 | A-1684322.1 | 587 | CCUAUUUCAUGAACUAUGUdTdT | A-1684323.1 | 588 | ACAUAGUUCAUGAAAUAGGdTdT | CCUAUUUCAUGAACUAUGU | 3331 |
| AD-887525 | A-1684324.1 | 589 | AUGUCUACUUGUGACUUUUdTdT | A-1684325.1 | 590 | AAAAGUCACAAGUAGACAUdTdT | AUGUCUACUUGUGACUUUU | 3332 |
| AD-887526 | A-1684326.1 | 591 | UGUCUACUUGUGACUUUUUdTdT | A-1684327.1 | 592 | AAAAAGUCACAAGUAGACAdTdT | UGUCUACUUGUGACUUUUU | 3333 |
| AD-887527 | A-1684328.1 | 593 | UCUACUUGUGACUUUUUAUdTdT | A-1684329.1 | 594 | AUAAAAAGUCACAAGUAGAdTdT | UCUACUUGUGACUUUUUAU | 3334 |
| AD-887528 | A-1684330.1 | 595 | CUACUUGUGACUUUUUAUCdTdT | A-1684331.1 | 596 | GAUAAAAAGUCACAAGUAGdTdT | CUACUUGUGACUUUUUAUC | 3335 |
| AD-887529 | A-1684332.1 | 597 | GUUCUAAAUAGCUAUUUCAdTdT | A-1684333.1 | 598 | UGAAAUAGCUAUUUAGAACdTdT | GUUCUAAAUAGCUAUUUCA | 3336 |

TABLE 2A-continued

Exemplary Human SCN9A siRNA Modified Single Strands and Duplex Sequences
Column 1 indicates duplex name. Column 2 indicates the name of the sense sequence. Column 3 indicates the sequence ID for the sequence of column 4. Column 4 provides the modified sequence of a sense strand suitable for use in a duplex described herein. Column 5 indicates the antisense sequence name. Column 6 indicates the sequence ID for the sequence of column 7. Column 7 provides the sequence of a modified antisense strand suitable for use in a duplex described herein, e.g., a duplex comprising the sense sequence in the same row of the table. Column 8 indicates the position in the target mRNA (NM_002977.3) that is complementary to the antisense strand of Column 7. Column9 indicated the sequence ID for the sequence of column 8.

| Duplex Name | Sense sequence name | Seq ID NO: (sense) | Sense sequence (5'-3') | Antisense sequence name | Seq ID NO: (antisense) | Antisense sequence (5'-3') | mRNA target sequence in NM_002977.3 | Seq ID NO: (mRNA target) |
|---|---|---|---|---|---|---|---|---|
| AD-887530 | A-1684334.1 | 599 | GCUGUUUACAUAGGAUUCUdTdT | A-1684335.1 | 600 | AGAAUCCUAUGUAAACAGCdTdT | GCUGUUUACAUAGGAUUCU | 3337 |
| AD-887531 | A-1684336.1 | 601 | GCUCAAAAUGUUUGAGUUUdTdT | A-1684337.1 | 602 | AAACUCAAACAUUUUGAGCdTdT | GCUCAAAAUGUUUGAGUUU | 3338 |

TABLE 2B

Exemplary Human SCN9A Unmodified Single Strands and Duplex Sequences.
Column 1 indicates duplex name. Column 2 indicates the sense sequence name. Column 3 indicates the sequence ID for the sequence of column 4. Column 4 provides the unmodified sequence of a sense strand suitable for use in a duplex described herein. Column 5 provides the position in the target mRNA (NM_002977.3) of the sense strand of Column 4. Column 6 indicates the antisense sequence name. Column 7 indicates the sequence ID for the sequence of column 8. Column 8 provides the sequence of an antisense strand suitable for use in a duplex described herein, without specifying chemical modifications. Column 9 indicates the position in the target mRNA (NM_002977.3) that is complementary to the antisense strand of Column 8.

| Duplex Name | Sense sequence name | Seq ID NO: (sense) | Sense sequence (5'-3') | mRNA target range in NM_002977.3 | Anti sense sequence name | Seq ID NO: (anti sense) | antisense sequence (5'-3') | mRNA target range in NM_002977.3 |
|---|---|---|---|---|---|---|---|---|
| AD-887232 | A-1683738.1 | 603 | UCACAAAACAGUCUCU UGC | 342-360 | A-1683739.1 | 604 | GCAAGAGACUGU UUUGUGA | 342-360 |
| AD-887233 | A-1683740.1 | 605 | GGAAAACAAUCUUCCG UUU | 579-597 | A-1683741.1 | 606 | AAACGGAAGAUU GUUUUCC | 579-597 |
| AD-887234 | A-1683742.1 | 607 | GAAAACAAUCUUCCGU UUC | 580-598 | A-1683743.1 | 608 | GAAACGGAAGAU UGUUUUC | 580-598 |
| AD-887235 | A-1683744.1 | 609 | AAAACAAUCUUCCGUU UCA | 581-599 | A-1683745.1 | 610 | UGAAACGGAAGA UUGUUUU | 581-599 |
| AD-887236 | A-1683746.1 | 611 | AAACAAUCUUCCGUUU CAA | 582-600 | A-1683747.1 | 612 | UUGAAACGGAAG AUUGUUU | 582-600 |
| AD-887237 | A-1683748.1 | 613 | AACAAUCUUCCGUUUC AAU | 583-601 | A-1683749.1 | 614 | AUUGAAACGGAA GAUUGUU | 583-601 |
| AD-887238 | A-1683750.1 | 615 | CAAUCUUCCGUUUCAA UGC | 585-603 | A-1683751.1 | 616 | GCAUUGAAACGG AAGAUUG | 585-603 |
| AD-887239 | A-1683752.1 | 617 | CCUGCUUUAUAUAUGC UUU | 608-626 | A-1683753.1 | 618 | AAAGCAUAUAUA AAGCAGG | 608-626 |
| AD-887240 | A-1683754.1 | 619 | CUGCUUUAUAUAUGC UUUC | 609-627 | A-1683755.1 | 620 | GAAAGCAUAUAU AAAGCAG | 609-627 |
| AD-887241 | A-1683756.1 | 621 | UAUGCUUUCUCCUUUC AGU | 619-637 | A-1683757.1 | 622 | ACUGAAAGGAGA AAGCAUA | 619-637 |
| AD-887242 | A-1683758.1 | 623 | AUGCUUUCUCCUUUCA GUC | 620-638 | A-1683759.1 | 624 | GACUGAAAGGAG AAAGCAU | 620-638 |
| AD-887243 | A-1683760.1 | 625 | UGCUUUCUCCUUUCAG UCC | 621-639 | A-1683761.1 | 626 | GGACUGAAAGGA GAAAGCA | 621-639 |
| AD-887244 | A-1683762.1 | 627 | CUUUCUCCUUUCAGUC CUC | 623-641 | A-1683763.1 | 628 | GAGGACUGAAAG GAGAAAG | 623-641 |

TABLE 2B-continued

Exemplary Human SCN9A Unmodified Single Strands and Duplex Sequences.
Column 1 indicates duplex name. Column 2 indicates the sense sequence name. Column 3 indicates the sequence ID for the sequence of column 4. Column 4 provides the unmodified sequence of a sense strand suitable for use in a duplex described herein. Column 5 provides the position in the target mRNA (NM_002977.3) of the sense strand of Column 4. Column 6 indicates the antisense sequence name. Column 7 indicates the sequence ID for the sequence of column 8. Column 8 provides the sequence of an antisense strand suitable for use in a duplex described herein, without specifying chemical modifications. Column 9 indicates the position in the target mRNA (NM_002977.3) that is complementary to the antisense strand of Column 8.

| Duplex Name | Sense sequence name | Seq ID NO: (sense) | Sense sequence (5'-3') | mRNA target range in NM_002977.3 | Anti sense sequence name | Seq ID NO: (anti sense) | antisense sequence (5'-3') | mRNA target range in NM_002977.3 |
|---|---|---|---|---|---|---|---|---|
| AD-887245 | A-1683764.1 | 629 | UCUCCUUUCAGUCCUCUAA | 626-644 | A-1683765.1 | 630 | UUAGAGGACUGAAAGGAGA | 626-644 |
| AD-887246 | A-1683766.1 | 631 | CUCCUUUCAGUCCUCUAAG | 627-645 | A-1683767.1 | 632 | CUUAGAGGACUGAAAGGAG | 627-645 |
| AD-887247 | A-1683768.1 | 633 | UCCUUUCAGUCCUCUAAGA | 628-646 | A-1683769.1 | 634 | UCUUAGAGGACUGAAAGGA | 628-646 |
| AD-887248 | A-1683770.1 | 635 | CCUUUCAGUCCUCUAAGAA | 629-647 | A-1683771.1 | 636 | UUCUUAGAGGACUGAAAGG | 629-647 |
| AD-887249 | A-1683772.1 | 637 | CUUUCAGUCCUCUAAGAAG | 630-648 | A-1683773.1 | 638 | CUUCUUAGAGGACUGAAAG | 630-648 |
| AD-887250 | A-1683774.1 | 639 | AGUCCUCUAAGAAGAAUAU | 635-653 | A-1683775.1 | 640 | AUAUUCUUCUUAGAGGACU | 635-653 |
| AD-887251 | A-1683776.1 | 641 | UCCUCUAAGAAGAAUAUCU | 637-655 | A-1683777.1 | 642 | AGAUAUUCUUCUUAGAGGA | 637-655 |
| AD-887252 | A-1683778.1 | 643 | CCUCUAAGAAGAAUAUCUA | 638-656 | A-1683779.1 | 644 | UAGAUAUUCUUCUUAGAGG | 638-656 |
| AD-887253 | A-1683780.1 | 645 | CUCUAAGAAGAAUAUCUAU | 639-657 | A-1683781.1 | 646 | AUAGAUAUUCUUCUUAGAG | 639-657 |
| AD-887254 | A-1683782.1 | 647 | AUUUUAGUACACUCCUUAU | 662-680 | A-1683783.1 | 648 | AUAAGGAGUGUACUAAAAU | 662-680 |
| AD-887255 | A-1683784.1 | 649 | UAGUACACUCCUUAUUCAG | 666-684 | A-1683785.1 | 650 | CUGAAUAAGGAGUGUACUA | 666-684 |
| AD-887256 | A-1683786.1 | 651 | AGUACACUCCUUAUUCAGC | 667-685 | A-1683787.1 | 652 | GCUGAAUAAGGAGUGUACU | 667-685 |
| AD-887257 | A-1683788.1 | 653 | CCUUAUUCAGCAUGCUCAU | 675-693 | A-1683789.1 | 654 | AUGAGCAUGCUGAAUAAGG | 675-693 |

TABLE 2B-continued

Exemplary Human SCN9A Unmodified Single Strands and Duplex Sequences.
Column 1 indicates duplex name. Column 2 indicates the sense sequence name. Column 3 indicates the sequence ID for the sequence of column 4. Column 4 provides the unmodified sequence of a sense strand suitable for use in a duplex described herein. Column 5 provides the position in the target mRNA (NM_002977.3) of the sense strand of Column 4. Column 6 indicates the antisense sequence name. Column 7 indicates the sequence ID for the sequence of column 8. Column 8 provides the sequence of an antisense strand suitable for use in a duplex described herein, without specifying chemical modifications. Column 9 indicates the position in the target mRNA (NM_002977.3) that is complementary to the antisense strand of Column 8.

| Duplex Name | Sense sequence name | Seq ID NO: (sense) | Sense sequence (5'-3') | mRNA target range in NM_002977.3 | Anti sense sequence name | Seq ID NO: (anti sense) | antisense sequence (5'-3') | mRNA target range in NM_002977.3 |
|---|---|---|---|---|---|---|---|---|
| AD-887258 | A-1683790.1 | 655 | UCAUCAUGUGCACUAUUCU | 690-708 | A-1683791.1 | 656 | AGAAUAGUGCACAUGAUGA | 690-708 |
| AD-887259 | A-1683792.1 | 657 | CAUCAUGUGCACUAUUCUG | 691-709 | A-1683793.1 | 658 | CAGAAUAGUGCACAUGAUG | 691-709 |
| AD-887260 | A-1683794.1 | 659 | UGUCGAGUACACUUUUACU | 760-778 | A-1683795.1 | 660 | AGUAAAAGUGUACUCGACA | 760-778 |
| AD-887261 | A-1683796.1 | 661 | GUCGAGUACACUUUUACUG | 761-779 | A-1683797.1 | 662 | CAGUAAAAGUGUACUCGAC | 761-779 |
| AD-887262 | A-1683798.1 | 663 | CUUCUGUGUAGGAGAAUUC | 823-841 | A-1683799.1 | 664 | GAAUUCUCCUACACAGAAG | 823-841 |
| AD-887263 | A-1683800.1 | 665 | UAGGAGAAUUCACUUUUCU | 831-849 | A-1683801.1 | 666 | AGAAAAGUGAAUUCUCCUA | 831-849 |
| AD-887264 | A-1683802.1 | 667 | AGGAGAAUUCACUUUUCUU | 832-850 | A-1683803.1 | 668 | AAGAAAAGUGAAUUCUCCU | 832-850 |
| AD-887265 | A-1683804.1 | 669 | GGAGAAUUCACUUUUCUUC | 833-851 | A-1683805.1 | 670 | GAAGAAAAGUGAAUUCUCC | 833-851 |
| AD-887266 | A-1683806.1 | 671 | GGCAAUGUUUCAGCUCUUC | 920-938 | A-1683807.1 | 672 | GAAGAGCUGAAACAUUGCC | 920-938 |
| AD-887267 | A-1683808.1 | 673 | AAUGUUUCAGCUCUUCGAA | 923-941 | A-1683809.1 | 674 | UUCGAAGAGCUGAAACAUU | 923-941 |
| AD-887268 | A-1683810.1 | 675 | GUUUCAGCUCUUCGAACUU | 926-944 | A-1683811.1 | 676 | AAGUUCGAAGAGCUGAAAC | 926-944 |
| AD-887269 | A-1683812.1 | 677 | UCAGCUCUUCGAACUUUCA | 929-947 | A-1683813.1 | 678 | UGAAAGUUCGAAGAGCUGA | 929-947 |
| AD-887270 | A-1683814.1 | 679 | AGCUCUUCGAACUUUCAGA | 931-949 | A-1683815.1 | 5804 | UCUGAAAGUUCGAAGAGCU | 931-949 |

TABLE 2B-continued

Exemplary Human SCN9A Unmodified Single Strands and Duplex Sequences. Column 1 indicates duplex name. Column 2 indicates the sense sequence name. Column 3 indicates the sequence ID for the sequence of column 4. Column 4 provides the unmodified sequence of a sense strand suitable for use in a duplex described herein. Column 5 provides the position in the target mRNA (NM_002977.3) of the sense strand of Column 4. Column 6 indicates the antisense sequence name. Column 7 indicates the sequence ID for the sequence of column 8. Column 8 provides the sequence of an antisense strand suitable for use in a duplex described herein, without specifying chemical modifications. Column 9 indicates the position in the target mRNA (NM_002977.3) that is complementary to the antisense strand of Column 8.

| Duplex Name | Sense sequence name | Seq ID NO: (sense) | Sense sequence (5'-3') | mRNA target range in NM_002977.3 | Anti sense sequence name | Seq ID NO: (anti sense) | antisense sequence (5'-3') | mRNA target range in NM_002977.3 |
|---|---|---|---|---|---|---|---|---|
| AD-887271 | A-1683816.1 | 5805 | CUCUUCGAACUUUCAG AGU | 933-951 | A- 1683817.1 | 5806 | ACUCUGAAAGUU CGAAGAG | 933-951 |
| AD-887272 | A-1683818.1 | 5807 | CUUCGAACUUUCAGAG UAU | 935-953 | A- 1683819.1 | 5808 | AUACUCUGAAAG UUCGAAG | 935-953 |
| AD-887273 | A-1683820.1 | 5809 | UCCUGACUGUGUUCU GUCU | 1047-1065 | A- 1683821.1 | 5810 | AGACAGAACACAG UCAGGA | 1047-1065 |
| AD-887274 | A-1683822.1 | 5811 | CUGACUGUGUUCUGU CUGA | 1049-1067 | A- 1683823.1 | 5812 | UCAGACAGAACAC AGUCAG | 1049-1067 |
| AD-887275 | A-1683824.1 | 5813 | UGACUGUGUUCUGUC UGAG | 1050-1068 | A- 1683825.1 | 680 | CUCAGACAGAACA CAGUCA | 1050-1068 |
| AD-887276 | A-1683826.1 | 681 | GACUGUGUUCUGUCU GAGU | 1051-1069 | A- 1683827.1 | 682 | ACUCAGACAGAAC ACAGUC | 1051-1069 |
| AD-887277 | A-1683828.1 | 683 | ACUGUGUUCUGUCUG AGUG | 1052-1070 | A- 1683829.1 | 684 | CACUCAGACAGAA CACAGU | 1052-1070 |
| AD-887278 | A-1683830.1 | 685 | CUGUGUUCUGUCUGA GUGU | 1053-1071 | A- 1683831.1 | 686 | ACACUCAGACAGA ACACAG | 1053-1071 |
| AD-887279 | A-1683832.1 | 687 | UGUGUUCUGUCUGAG UGUG | 1054-1072 | A- 1683833.1 | 688 | CACACUCAGACAG AACACA | 1054-1072 |
| AD-887280 | A-1683834.1 | 689 | UGUUCUGUCUGAGUG UGUU | 1056-1074 | A- 1683835.1 | 690 | AACACACUCAGAC AGAACA | 1056-1074 |
| AD-887281 | A-1683836.1 | 691 | GUUCUGUCUGAGUGU GUUU | 1057-1075 | A- 1683837.1 | 692 | AAACACACUCAGA CAGAAC | 1057-1075 |
| AD-887282 | A-1683838.1 | 693 | UUCUGUCUGAGUGUG UUUG | 1058-1076 | A- 1683839.1 | 694 | CAAACACACUCAG ACAGAA | 1058-1076 |
| AD-887283 | A-1683840.1 | 695 | UCUGUCUGAGUGUGU UUGC | 1059-1077 | A- 1683841.1 | 696 | GCAAACACACUCA GACAGA | 1059-1077 |

TABLE 2B-continued

Exemplary Human SCN9A Unmodified Single Strands and Duplex Sequences.
Column 1 indicates duplex name. Column 2 indicates the sense sequence name. Column 3 indicates the sequence ID for the sequence of column 4. Column 4 provides the unmodified sequence of a sense strand suitable for use in a duplex described herein. Column 5 provides the position in the target mRNA (NM_002977.3) of the sense strand of Column 4. Column 6 indicates the antisense sequence name. Column 7 indicates the sequence ID for the sequence of column 8. Column 8 provides the sequence of an antisense strand suitable for use in a duplex described herein, without specifying chemical modifications. Column 9 indicates the position in the target mRNA (NM_002977.3) that is complementary to the antisense strand of Column 8.

| Duplex Name | Sense sequence name | Seq ID NO: (sense) | Sense sequence (5'-3') | mRNA target range in NM_002977.3 | Anti sense sequence name | Seq ID NO: (anti sense) | antisense sequence (5'-3') | mRNA target range in NM_002977.3 |
|---|---|---|---|---|---|---|---|---|
| AD-887284 | A-1683842.1 | 697 | UGCUCUCCUUUGUGGUUUC | 1231-1249 | A-1683843.1 | 698 | GAAACCACAAAGGAGAGCA | 1231-1249 |
| AD-887285 | A-1683844.1 | 699 | CUCUCCUUUGUGGUUUCAG | 1233-1251 | A-1683845.1 | 700 | CUGAAACCACAAAGGAGAG | 1233-1251 |
| AD-887286 | A-1683846.1 | 701 | UCUCCUUUGUGGUUUCAGC | 1234-1252 | A-1683847.1 | 702 | GCUGAAACCACAAAGGAGA | 1234-1252 |
| AD-887287 | A-1683848.1 | 703 | CUCCUUUGUGGUUUCAGCA | 1235-1253 | A-1683849.1 | 704 | UGCUGAAACCACAAAGGAG | 1235-1253 |
| AD-887288 | A-1683850.1 | 705 | CGAGCUUUGACACUUUCAG | 1323-1341 | A-1683851.1 | 706 | CUGAAAGUGUCAAAGCUCG | 1323-1341 |
| AD-887289 | A-1683852.1 | 707 | ACAUGAUCUUCUUUGUCGU | 1431-1449 | A-1683853.1 | 708 | ACGACAAAGAAGAUCAUGU | 1431-1449 |
| AD-887290 | A-1683854.1 | 709 | CAUGAUCUUCUUUGUCGUA | 1432-1450 | A-1683855.1 | 710 | UACGACAAAGAAGAUCAUG | 1432-1450 |
| AD-887291 | A-1683856.1 | 711 | GAUCUUCUUUGUCGUAGUG | 1435-1453 | A-1683857.1 | 712 | CACUACGACAAAGAAGAUC | 1435-1453 |
| AD-887292 | A-1683858.1 | 713 | UCUUCUUUGUCGUAGUGAU | 1437-1455 | A-1683859.1 | 714 | AUCACUACGACAAAGAAGA | 1437-1455 |
| AD-887293 | A-1683860.1 | 715 | CUUCUUUGUCGUAGUGAUU | 1438-1456 | A-1683861.1 | 716 | AAUCACUACGACAAAGAAG | 1438-1456 |
| AD-887294 | A-1683862.1 | 717 | UUGUCGUAGUGAUUUUCCU | 1443-1461 | A-1683863.1 | 718 | AGGAAAAUCACUACGACAA | 1443-1461 |
| AD-887295 | A-1683864.1 | 719 | GCUCCUUUUAUCUAAUAAA | 1464-1482 | A-1683865.1 | 720 | UUUAUUAGAUAAAAGGAGC | 1464-1482 |
| AD-887296 | A-1683866.1 | 721 | CUCCUUUUAUCUAAUAAAC | 1465-1483 | A-1683867.1 | 722 | GUUUAUUAGAUAAAAGGAG | 1465-1483 |

TABLE 2B-continued

Exemplary Human SCN9A Unmodified Single Strands and Duplex Sequences.
Column 1 indicates duplex name. Column 2 indicates the sense sequence name. Column 3 indicates the sequence ID for the sequence of column 4. Column 4 provides the unmodified sequence of a sense strand suitable for use in a duplex described herein. Column 5 provides the position in the target mRNA (NM_002977.3) of the sense strand of Column 4. Column 6 indicates the antisense sequence name. Column 7 indicates the sequence ID for the sequence of column 8. Column 8 provides the sequence of an antisense strand suitable for use in a duplex described herein, without specifying chemical modifications. Column 9 indicates the position in the target mRNA (NM_002977.3) that is complementary to the antisense strand of Column 8.

| Duplex Name | Sense sequence name | Seq ID NO: (sense) | Sense sequence (5'-3') | mRNA target range in NM_002977.3 | Anti sense sequence name | Seq ID NO: (anti sense) | antisense sequence (5'-3') | mRNA target range in NM_002977.3 |
|---|---|---|---|---|---|---|---|---|
| AD-887297 | A-1683868.1 | 723 | CCUCUCAGAGAGUUCU UCU | 1669-1687 | A-1683869.1 | 724 | AGAAGAACUCUC UGAGAGG | 1669-1687 |
| AD-887298 | A-1683870.1 | 725 | CUCUCAGAGAGUUCUU CUG | 1670-1688 | A-1683871.1 | 726 | CAGAAGAACUCUC UGAGAG | 1670-1688 |
| AD-887299 | A-1683872.1 | 727 | UCUCAGAGAGUUCUUC UGA | 1671-1689 | A-1683873.1 | 728 | UCAGAAGAACUC UCUGAGA | 1671-1689 |
| AD-887300 | A-1683874.1 | 729 | CUCAGAGAGUUCUUCU GAA | 1672-1690 | A-1683875.1 | 730 | UUCAGAAGAACU CUCUGAG | 1672-1690 |
| AD-887301 | A-1683876.1 | 731 | UCAGAGAGUUCUUCU GAAA | 1673-1691 | A-1683877.1 | 732 | UUUCAGAAGAAC UCUCUGA | 1673-1691 |
| AD-887302 | A-1683878.1 | 733 | CAGAGAGUUCUUCUGA AAC | 1674-1692 | A-1683879.1 | 734 | GUUUCAGAAGAA CUCUCUG | 1674-1692 |
| AD-887303 | A-1683880.1 | 735 | GAGAGUUCUUCUGAA ACAU | 1676-1694 | A-1683881.1 | 736 | AUGUUUCAGAAG AACUCUC | 1676-1694 |
| AD-887304 | A-1683882.1 | 737 | AGAGUUCUUCUGAAAC AUC | 1677-1695 | A-1683883.1 | 738 | GAUGUUUCAGAA GAACUCU | 1677-1695 |
| AD-887305 | A-1683884.1 | 739 | GAGUUCUUCUGAAACA UCC | 1678-1696 | A-1683885.1 | 740 | GGAUGUUUCAGA AGAACUC | 1678-1696 |
| AD-887306 | A-1683886.1 | 741 | AGUUCUUCUGAAACAU CCA | 1679-1697 | A-1683887.1 | 742 | UGGAUGUUUCAG AAGAACU | 1679-1697 |
| AD-887307 | A-1683888.1 | 743 | GUUCUUCUGAAACAUC CAA | 1680-1698 | A-1683889.1 | 744 | UUGGAUGUUUCA GAAGAAC | 1680-1698 |
| AD-887308 | A-1683890.1 | 745 | UCUUCUGAAACAUCCA AAC | 1682-1700 | A-1683891.1 | 746 | GUUUGGAUGUUU CAGAAGA | 1682-1700 |
| AD-887309 | A-1683892.1 | 747 | CUUCUGAAACAUCCAA ACU | 1683-1701 | A-1683893.1 | 748 | AGUUUGGAUGUU UCAGAAG | 1683-1701 |

TABLE 2B-continued

Exemplary Human SCN9A Unmodified Single Strands and Duplex Sequences.
Column 1 indicates duplex name. Column 2 indicates the sense sequence name. Column 3 indicates the sequence ID for the sequence of column 4. Column 4 provides the unmodified sequence of a sense strand suitable for use in a duplex described herein. Column 5 provides the position in the target mRNA (NM_002977.3) of the sense strand of Column 4. Column 6 indicates the antisense sequence name. Column 7 indicates the sequence ID for the sequence of column 8. Column 8 provides the sequence of an antisense strand suitable for use in a duplex described herein, without specifying chemical modifications. Column 9 indicates the position in the target mRNA (NM_002977.3) that is complementary to the antisense strand of Column 8.

| Duplex Name | Sense sequence name | Seq ID NO: (sense) | Sense sequence (5'-3') | mRNA target range in NM_002977.3 | Anti sense sequence name | Seq ID NO: (anti sense) | antisense sequence (5'-3') | mRNA target range in NM_002977.3 |
|---|---|---|---|---|---|---|---|---|
| AD-887310 | A-1683894.1 | 749 | UCUGAAACAUCCAAACUGA | 1685-1703 | A-1683895.1 | 750 | UCAGUUUGGAUGUUUCAGA | 1685-1703 |
| AD-887311 | A-1683896.1 | 751 | UCCAAACUGAGCUCUAAAA | 1694-1712 | A-1683897.1 | 752 | UUUUAGAGCUCAGUUUGGA | 1694-1712 |
| AD-887312 | A-1683898.1 | 753 | AGGCGUUGUAGUUCCUAUC | 2300-2318 | A-1683899.1 | 754 | GAUAGGAACUACAACGCCU | 2300-2318 |
| AD-887313 | A-1683900.1 | 755 | GCGUUGUAGUUCCUAUCUC | 2302-2320 | A-1683901.1 | 756 | GAGAUAGGAACUACAACGC | 2302-2320 |
| AD-887314 | A-1683902.1 | 757 | CGUUGUAGUUCCUAUCUCC | 2303-2321 | A-1683903.1 | 758 | GGAGAUAGGAACUACAACG | 2303-2321 |
| AD-887315 | A-1683904.1 | 759 | GUUGUAGUUCCUAUCUCCU | 2304-2322 | A-1683905.1 | 760 | AGGAGAUAGGAACUACAAC | 2304-2322 |
| AD-887316 | A-1683906.1 | 761 | UUGUAGUUCCUAUCUCCUU | 2305-2323 | A-1683907.1 | 762 | AAGGAGAUAGGAACUACAA | 2305-2323 |
| AD-887317 | A-1683908.1 | 763 | UGUAGUUCCUAUCUCCUUU | 2306-2324 | A-1683909.1 | 764 | AAAGGAGAUAGGAACUACA | 2306-2324 |
| AD-887318 | A-1683910.1 | 765 | GUAGUUCCUAUCUCCUUUC | 2307-2325 | A-1683911.1 | 766 | GAAAGGAGAUAGGAACUAC | 2307-2325 |
| AD-887319 | A-1683912.1 | 767 | UAGUUCCUAUCUCCUUUCA | 2308-2326 | A-1683913.1 | 768 | UGAAAGGAGAUAGGAACUA | 2308-2326 |
| AD-887320 | A-1683914.1 | 769 | AGUUCCUAUCUCCUUUCAG | 2309-2327 | A-1683915.1 | 770 | CUGAAAGGAGAUAGGAACU | 2309-2327 |
| AD-887321 | A-1683916.1 | 771 | GUUCCUAUCUCCUUUCAGA | 2310-2328 | A-1683917.1 | 772 | UCUGAAAGGAGAUAGGAAC | 2310-2328 |
| AD-887322 | A-1683918.1 | 773 | UUCCUAUCUCCUUUCAGAG | 2311-2329 | A-1683919.1 | 774 | CUCUGAAAGGAGAUAGGAA | 2311-2329 |

TABLE 2B-continued

Exemplary Human SCN9A Unmodified Single Strands and Duplex Sequences.
Column 1 indicates duplex name. Column 2 indicates the sense sequence name. Column 3 indicates the sequence ID for the sequence of column 4. Column 4 provides the unmodified sequence of a sense strand suitable for use in a duplex described herein. Column 5 provides the position in the target mRNA (NM_002977.3) of the sense strand of Column 4. Column 6 indicates the antisense sequence name. Column 7 indicates the sequence ID for the sequence of column 8. Column 8 provides the sequence of an antisense strand suitable for use in a duplex described herein, without specifying chemical modifications. Column 9 indicates the position in the target mRNA (NM_002977.3) that is complementary to the antisense strand of Column 8.

| Duplex Name | Sense sequence name | Seq ID NO: (sense) | Sense sequence (5'-3') | mRNA target range in NM_002977.3 | Anti sense sequence name | Seq ID NO: (anti sense) | antisense sequence (5'-3') | mRNA target range in NM_002977.3 |
|---|---|---|---|---|---|---|---|---|
| AD-887323 | A-1683920.1 | 775 | UCCUAUCUCCUUUCAGAGG | 2312-2330 | A-1683921.1 | 776 | CCUCUGAAAGGAGAUAGGA | 2312-2330 |
| AD-887324 | A-1683922.1 | 777 | UCUCCUUUCAGAGGAUAUG | 2317-2335 | A-1683923.1 | 778 | CAUAUCCUCUGAAAGGAGA | 2317-2335 |
| AD-887325 | A-1683924.1 | 779 | GCAUAUUAACAAACACUGU | 2379-2397 | A-1683925.1 | 780 | ACAGUGUUUGUUAAUAUGC | 2379-2397 |
| AD-887326 | A-1683926.1 | 781 | CUUGAUCUGGAAUUGCUCU | 2461-2479 | A-1683927.1 | 782 | AGAGCAAUUCCAGAUCAAG | 2461-2479 |
| AD-887327 | A-1683928.1 | 783 | CUCUCCAUAUUGGAUAAAA | 2476-2494 | A-1683929.1 | 784 | UUUUAUCCAAUAUGGAGAG | 2476-2494 |
| AD-887328 | A-1683930.1 | 785 | UCUCCAUAUUGGAUAAAAU | 2477-2495 | A-1683931.1 | 786 | AUUUUAUCCAAUAUGGAGA | 2477-2495 |
| AD-887329 | A-1683932.1 | 787 | CUCCAUAUUGGAUAAAAUU | 2478-2496 | A-1683933.1 | 788 | AAUUUUAUCCAAUAUGGAG | 2478-2496 |
| AD-887330 | A-1683934.1 | 789 | GAUCUUGCAAUUACCAUUU | 2537-2555 | A-1683935.1 | 790 | AAAUGGUAAUUGCAAGAUC | 2537-2555 |
| AD-887331 | A-1683936.1 | 791 | UUGGUCUUUACUGGAAUCU | 2639-2657 | A-1683937.1 | 792 | AGAUUCCAGUAAAGACCAA | 2639-2657 |
| AD-887332 | A-1683938.1 | 793 | GGUCUUUACUGGAAUCUUU | 2641-2659 | A-1683939.1 | 794 | AAAGAUUCCAGUAAAGACC | 2641-2659 |
| AD-887333 | A-1683940.1 | 795 | GUCUUUACUGGAAUCUUUG | 2642-2660 | A-1683941.1 | 796 | CAAAGAUUCCAGUAAAGAC | 2642-2660 |
| AD-887334 | A-1683942.1 | 797 | GCCUUAUUGUGACUUUAAG | 2736-2754 | A-1683943.1 | 798 | CUUAAAGUCACAAUAAGGC | 2736-2754 |
| AD-887335 | A-1683944.1 | 799 | GCUCUUUCUAGCAGAUGUG | 2764-2782 | A-1683945.1 | 800 | CACAUCUGCUAGAAAGAGC | 2764-2782 |

TABLE 2B-continued

Exemplary Human SCN9A Unmodified Single Strands and Duplex Sequences.
Column 1 indicates duplex name. Column 2 indicates the sense sequence name. Column 3 indicates the sequence ID for the sequence of column 4. Column 4 provides the unmodified sequence of a sense strand suitable for use in a duplex described herein. Column 5 provides the position in the target mRNA (NM_002977.3) of the sense strand of Column 4. Column 6 indicates the antisense sequence name. Column 7 indicates the sequence ID for the sequence of column 8. Column 8 provides the sequence of an antisense strand suitable for use in a duplex described herein, without specifying chemical modifications. Column 9 indicates the position in the target mRNA (NM_002977.3) that is complementary to the antisense strand of Column 8.

| Duplex Name | Sense sequence name | Seq ID NO: (sense) | Sense sequence (5'-3') | mRNA target range in NM_002977.3 | Anti sense sequence name | Seq ID NO: (anti sense) | antisense sequence (5'-3') | mRNA target range in NM_002977.3 |
|---|---|---|---|---|---|---|---|---|
| AD-887336 | A-1683946.1 | 801 | CUCUUUCUAGCAGAUG UGG | 2765-2783 | A-1683947.1 | 802 | CCACAUCUGCUAG AAAGAG | 2765-2783 |
| AD-887337 | A-1683948.1 | 803 | GUCAGUUCUGCGAUCA UUC | 2791-2809 | A-1683949.1 | 804 | GAAUGAUCGCAG AACUGAC | 2791-2809 |
| AD-887338 | A-1683950.1 | 805 | UCAGUUCUGCGAUCAU UCA | 2792-2810 | A-1683951.1 | 806 | UGAAUGAUCGCA GAACUGA | 2792-2810 |
| AD-887339 | A-1683952.1 | 807 | AGUCUUCAAGUUGGCA AAA | 2821-2839 | A-1683953.1 | 808 | UUUUGCCAACUU GAAGACU | 2821-2839 |
| AD-887340 | A-1683954.1 | 809 | UCUUCAAGUUGGCAAA AUC | 2823-2841 | A-1683955.1 | 810 | GAUUUUGCCAAC UUGAAGA | 2823-2841 |
| AD-887341 | A-1683956.1 | 811 | CUUCAAGUUGGCAAAA UCC | 2824-2842 | A-1683957.1 | 812 | GGAUUUUGCCAA CUUGAAG | 2824-2842 |
| AD-887342 | A-1683958.1 | 813 | CCAUCAUCGUCUUCAU UUU | 2919-2937 | A-1683959.1 | 814 | AAAAUGAAGACG AUGAUGG | 2919-2937 |
| AD-887343 | A-1683960.1 | 815 | CAUCAUCGUCUUCAUU UUU | 2920-2938 | A-1683961.1 | 816 | AAAAAUGAAGAC GAUGAUG | 2920-2938 |
| AD-887344 | A-1683962.1 | 817 | GCACAUGAACGACUUC UUC | 3022-3040 | A-1683963.1 | 818 | GAAGAAGUCGUU CAUGUGC | 3022-3040 |
| AD-887345 | A-1683964.1 | 819 | CACAUGAACGACUUCU UCC | 3023-3041 | A-1683965.1 | 820 | GGAAGAAGUCGU UCAUGUG | 3023-3041 |
| AD-887346 | A-1683966.1 | 821 | ACAUGAACGACUUCUU CCA | 3024-3042 | A-1683967.1 | 822 | UGGAAGAAGUCG UUCAUGU | 3024-3042 |
| AD-887347 | A-1683968.1 | 823 | CAUGAACGACUUCUUC CAC | 3025-3043 | A-1683969.1 | 824 | GUGGAAGAAGUC GUUCAUG | 3025-3043 |
| AD-887348 | A-1683970.1 | 825 | UGAACGACUUCUUCCA CUC | 3027-3045 | A-1683971.1 | 826 | GAGUGGAAGAAG UCGUUCA | 3027-3045 |

TABLE 2B-continued

Exemplary Human SCN9A Unmodified Single Strands and Duplex Sequences. Column 1 indicates duplex name. Column 2 indicates the sense sequence name. Column 3 indicates the sequence ID for the sequence of column 4. Column 4 provides the unmodified sequence of a sense strand suitable for use in a duplex described herein. Column 5 provides the position in the target mRNA (NM_002977.3) of the sense strand of Column 4. Column 6 indicates the antisense sequence name. Column 7 indicates the sequence ID for the sequence of column 8. Column 8 provides the sequence of an antisense strand suitable for use in a duplex described herein, without specifying chemical modifications. Column 9 indicates the position in the target mRNA (NM_002977.3) that is complementary to the antisense strand of Column 8.

| Duplex Name | Sense sequence name | Seq ID NO: (sense) | Sense sequence (5'-3') | mRNA target range in NM_002977.3 | Anti sense sequence name | Seq ID NO: (anti sense) | antisense sequence (5'-3') | mRNA target range in NM_002977.3 |
|---|---|---|---|---|---|---|---|---|
| AD-887349 | A-1683972.1 | 827 | CGACUUCUUCCACUCC UUC | 3031-3049 | A-1683973.1 | 828 | GAAGGAGUGGAA GAAGUCG | 3031-3049 |
| AD-887350 | A-1683974.1 | 829 | UCCACUCCUUCCUGAU UGU | 3039-3057 | A-1683975.1 | 830 | ACAAUCAGGAAG GAGUGGA | 3039-3057 |
| AD-887351 | A-1683976.1 | 831 | ACUCCUUCCUGAUUGU GUU | 3042-3060 | A-1683977.1 | 832 | AACACAAUCAGGA AGGAGU | 3042-3060 |
| AD-887352 | A-1683978.1 | 833 | CUCCUUCCUGAUUGUG UUC | 3043-3061 | A-1683979.1 | 834 | GAACACAAUCAGG AAGGAG | 3043-3061 |
| AD-887353 | A-1683980.1 | 835 | UCCUUCCUGAUUGUG UUCC | 3044-3062 | A-1683981.1 | 836 | GGAACACAAUCAG GAAGGA | 3044-3062 |
| AD-887354 | A-1683982.1 | 837 | CUAUGUGCCUUAUUG UUUA | 3123-3141 | A-1683983.1 | 838 | UAAACAAUAAGG CACAUAG | 3123-3141 |
| AD-887355 | A-1683984.1 | 839 | UGGUCCUAAACCUAUU UCU | 3171-3189 | A-1683985.1 | 840 | AGAAAUAGGUUU AGGACCA | 3171-3189 |
| AD-887356 | A-1683986.1 | 841 | GGUCCUAAACCUAUUU CUG | 3172-3190 | A-1683987.1 | 842 | CAGAAAUAGGUU UAGGACC | 3172-3190 |
| AD-887357 | A-1683988.1 | 843 | GUCCUAAACCUAUUUC UGG | 3173-3191 | A-1683989.1 | 844 | CCAGAAAUAGGU UUAGGAC | 3173-3191 |
| AD-887358 | A-1683990.1 | 845 | CCUUACGUGAAUUUA UUCU | 3312-3330 | A-1683991.1 | 846 | AGAAUAAAUUCA CGUAAGG | 3312-3330 |
| AD-887359 | A-1683992.1 | 847 | CAAAGGUCACAAUUUC CUC | 3439-3457 | A-1683993.1 | 848 | GAGGAAAUUGUG ACCUUUG | 3439-3457 |
| AD-887360 | A-1683994.1 | 849 | UCACAAUUUCCUCAAG GAA | 3445-3463 | A-1683995.1 | 850 | UUCCUUGAGGAA AUUGUGA | 3445-3463 |
| AD-887361 | A-1683996.1 | 851 | CCUCAAGGAAAAAGAU AAA | 3454-3472 | A-1683997.1 | 852 | UUUAUCUUUUUC CUUGAGG | 3454-3472 |

TABLE 2B-continued

Exemplary Human SCN9A Unmodified Single Strands and Duplex Sequences.
Column 1 indicates duplex name. Column 2 indicates the sense sequence name. Column 3 indicates the sequence ID for the sequence of column 4. Column 4 provides the unmodified sequence of a sense strand suitable for use in a duplex described herein. Column 5 provides the position in the target mRNA (NM_002977.3) of the sense strand of Column 4. Column 6 indicates the antisense sequence name. Column 7 indicates the sequence ID for the sequence of column 8. Column 8 provides the sequence of an antisense strand suitable for use in a duplex described herein, without specifying chemical modifications. Column 9 indicates the position in the target mRNA (NM_002977.3) that is complementary to the antisense strand of Column 8.

| Duplex Name | Sense sequence name | Seq ID NO: (sense) | Sense sequence (5'-3') | mRNA target range in NM_002977.3 | Anti sense sequence name | Seq ID NO: (anti sense) | antisense sequence (5'-3') | mRNA target range in NM_002977.3 |
|---|---|---|---|---|---|---|---|---|
| AD-887362 | A-1683998.1 | 853 | GCUUCAUUGUCCUCAU GAU | 3885-3903 | A-1683999.1 | 854 | AUCAUGAGGACA AUGAAGC | 3885-3903 |
| AD-887363 | A-1684000.1 | 855 | CUUCAUUGUCCUCAUG AUC | 3886-3904 | A-1684001.1 | 856 | GAUCAUGAGGAC AAUGAAG | 3886-3904 |
| AD-887364 | A-1684002.1 | 857 | UGCAGACAAGAUCUUC ACU | 3982-4000 | A-1684003.1 | 858 | AGUGAAGAUCUU GUCUGCA | 3982-4000 |
| AD-887365 | A-1684004.1 | 859 | CAGACAAGAUCUUCAC UUA | 3984-4002 | A-1684005.1 | 860 | UAAGUGAAGAUC UUGUCUG | 3984-4002 |
| AD-887366 | A-1684006.1 | 861 | AGACAAGAUCUUCACU UAC | 3985-4003 | A-1684007.1 | 862 | GUAAGUGAAGAU CUUGUCU | 3985-4003 |
| AD-887367 | A-1684008.1 | 863 | GACAAGAUCUUCACUU ACA | 3986-4004 | A-1684009.1 | 864 | UGUAAGUGAAGA UCUUGUC | 3986-4004 |
| AD-887368 | A-1684010.1 | 865 | ACAAGAUCUUCACUUA CAU | 3987-4005 | A-1684011.1 | 866 | AUGUAAGUGAAG AUCUUGU | 3987-4005 |
| AD-887369 | A-1684012.1 | 867 | CAAGAUCUUCACUUAC AUC | 3988-4006 | A-1684013.1 | 868 | GAUGUAAGUGAA GAUCUUG | 3988-4006 |
| AD-887370 | A-1684014.1 | 869 | AGAUCUUCACUUACAU CUU | 3990-4008 | A-1684015.1 | 870 | AAGAUGUAAGUG AAGAUCU | 3990-4008 |
| AD-887371 | A-1684016.1 | 871 | GAUCUUCACUUACAUC UUC | 3991-4009 | A-1684017.1 | 872 | GAAGAUGUAAGU GAAGAUC | 3991-4009 |
| AD-887372 | A-1684018.1 | 873 | UCUUCACUUACAUCUU CAU | 3993-4011 | A-1684019.1 | 874 | AUGAAGAUGUAA GUGAAGA | 3993-4011 |
| AD-887373 | A-1684020.1 | 875 | CUUCACUUACAUCUUC AUU | 3994-4012 | A-1684021.1 | 876 | AAUGAAGAUGUA AGUGAAG | 3994-4012 |
| AD-887374 | A-1684022.1 | 877 | UUCACUUACAUCUUCA UUC | 3995-4013 | A-1684023.1 | 878 | GAAUGAAGAUGU AAGUGAA | 3995-4013 |

TABLE 2B-continued

Exemplary Human SCN9A Unmodified Single Strands and Duplex Sequences.
Column 1 indicates duplex name. Column 2 indicates the sense sequence name. Column 3 indicates the sequence ID for the sequence of column 4. Column 4 provides the unmodified sequence of a sense strand suitable for use in a duplex described herein. Column 5 provides the position in the target mRNA (NM_002977.3) of the sense strand of Column 4. Column 6 indicates the antisense sequence name. Column 7 indicates the sequence ID for the sequence of column 8. Column 8 provides the sequence of an antisense strand suitable for use in a duplex described herein, without specifying chemical modifications. Column 9 indicates the position in the target mRNA (NM_002977.3) that is complementary to the antisense strand of Column 8.

| Duplex Name | Sense sequence name | Seq ID NO: (sense) | Sense sequence (5'-3') | mRNA target range in NM_002977.3 | Anti sense sequence name | Seq ID NO: (anti sense) | antisense sequence (5'-3') | mRNA target range in NM_002977.3 |
|---|---|---|---|---|---|---|---|---|
| AD-887375 | A-1684024.1 | 879 | UCACUUACAUCUUCAUUCU | 3996-4014 | A-1684025.1 | 880 | AGAAUGAAGAUGUAAGUGA | 3996-4014 |
| AD-887376 | A-1684026.1 | 881 | CACUUACAUCUUCAUUCUG | 3997-4015 | A-1684027.1 | 882 | CAGAAUGAAGAUGUAAGUG | 3997-4015 |
| AD-887377 | A-1684028.1 | 883 | CUUACAUCUUCAUUCUGGA | 3999-4017 | A-1684029.1 | 884 | UCCAGAAUGAAGAUGUAAG | 3999-4017 |
| AD-887378 | A-1684030.1 | 885 | ACAUCUUCAUUCUGGAAAU | 4002-4020 | A-1684031.1 | 886 | AUUUCCAGAAUGAAGAUGU | 4002-4020 |
| AD-887379 | A-1684032.1 | 887 | CAUCUUCAUUCUGGAAAUG | 4003-4021 | A-1684033.1 | 888 | CAUUUCCAGAAUGAAGAUG | 4003-4021 |
| AD-887380 | A-1684034.1 | 889 | UCUUCAUUCUGGAAAUGCU | 4005-4023 | A-1684035.1 | 890 | AGCAUUUCCAGAAUGAAGA | 4005-4023 |
| AD-887381 | A-1684036.1 | 891 | CUUCAUUCUGGAAAUGCUU | 4006-4024 | A-1684037.1 | 892 | AAGCAUUUCCAGAAUGAAG | 4006-4024 |
| AD-887382 | A-1684038.1 | 893 | UCUGGAAAUGCUUCUAAAA | 4012-4030 | A-1684039.1 | 894 | UUUUAGAAGCAUUUCCAGA | 4012-4030 |
| AD-887383 | A-1684040.1 | 895 | GCUGGAUUUCCUAAUUGUU | 4078-4096 | A-1684041.1 | 896 | AACAAUUAGGAAAUCCAGC | 4078-4096 |
| AD-887384 | A-1684042.1 | 897 | CUGGAUUUCCUAAUUGUUG | 4079-4097 | A-1684043.1 | 898 | CAACAAUUAGGAAAUCCAG | 4079-4097 |
| AD-887385 | A-1684044.1 | 899 | CCUCUAAGAGCCUUAUCUA | 4187-4205 | A-1684045.1 | 900 | UAGAUAAGGCUCUUAGAGG | 4187-4205 |
| AD-887386 | A-1684046.1 | 901 | CUCUAAGAGCCUUAUCUAG | 4188-4206 | A-1684047.1 | 902 | CUAGAUAAGGCUCUUAGAG | 4188-4206 |
| AD-887387 | A-1684048.1 | 903 | CUUCCAUCAUGAAUGUGCU | 4254-4272 | A-1684049.1 | 904 | AGCACAUUCAUGAUGGAAG | 4254-4272 |

TABLE 2B-continued

Exemplary Human SCN9A Unmodified Single Strands and Duplex Sequences.
Column 1 indicates duplex name. Column 2 indicates the sense sequence name. Column 3 indicates the sequence ID for the sequence of column 4. Column 4 provides the unmodified sequence of a sense strand suitable for use in a duplex described herein. Column 5 provides the position in the target mRNA (NM_002977.3) of the sense strand of Column 4. Column 6 indicates the antisense sequence name. Column 7 indicates the sequence ID for the sequence of column 8. Column 8 provides the sequence of an antisense strand suitable for use in a duplex described herein, without specifying chemical modifications. Column 9 indicates the position in the target mRNA (NM_002977.3) that is complementary to the antisense strand of Column 8.

| Duplex Name | Sense sequence name | Seq ID NO: (sense) | Sense sequence (5'-3') | mRNA target range in NM_002977.3 | Anti sense sequence name | Seq ID NO: (anti sense) | antisense sequence (5'-3') | mRNA target range in NM_002977.3 |
|---|---|---|---|---|---|---|---|---|
| AD-887388 | A-1684050.1 | 905 | UUUCCUGCAAGUCAAGUUC | 4373-4391 | A-1684051.1 | 906 | GAACUUGACUUGCAGGAAA | 4373-4391 |
| AD-887389 | A-1684052.1 | 907 | CUGCAAGUCAAGUUCCAAA | 4377-4395 | A-1684053.1 | 908 | UUUGGAACUUGACUUGCAG | 4377-4395 |
| AD-887390 | A-1684054.1 | 909 | AGUCAAGUUCCAAAUCGUU | 4382-4400 | A-1684055.1 | 910 | AACGAUUUGGAACUUGACU | 4382-4400 |
| AD-887391 | A-1684056.1 | 911 | ACUUGGUUACCUAUCUCUG | 4477-4495 | A-1684057.1 | 912 | CAGAGAUAGGUAACCAAGU | 4477-4495 |
| AD-887392 | A-1684058.1 | 913 | CUUGGUUACCUAUCUCUGC | 4478-4496 | A-1684059.1 | 914 | GCAGAGAUAGGUAACCAAG | 4478-4496 |
| AD-887393 | A-1684060.1 | 915 | GGUUACCUAUCUCUGCUUC | 4481-4499 | A-1684061.1 | 916 | GAAGCAGAGAUAGGUAACC | 4481-4499 |
| AD-887394 | A-1684062.1 | 917 | GUUACCUAUCUCUGCUUCA | 4482-4500 | A-1684063.1 | 918 | UGAAGCAGAGAUAGGUAAC | 4482-4500 |
| AD-887395 | A-1684064.1 | 919 | UUACCUAUCUCUGCUUCAA | 4483-4501 | A-1684065.1 | 920 | UUGAAGCAGAGAUAGGUAA | 4483-4501 |
| AD-887396 | A-1684066.1 | 921 | UACCUAUCUCUGCUUCAAG | 4484-4502 | A-1684067.1 | 922 | CUUGAAGCAGAGAUAGGUA | 4484-4502 |
| AD-887397 | A-1684068.1 | 923 | ACCUAUCUCUGCUUCAAGU | 4485-4503 | A-1684069.1 | 924 | ACUUGAAGCAGAGAUAGGU | 4485-4503 |
| AD-887398 | A-1684070.1 | 925 | CCUAUCUCUGCUUCAAGUU | 4486-4504 | A-1684071.1 | 926 | AACUUGAAGCAGAGAUAGG | 4486-4504 |
| AD-887399 | A-1684072.1 | 927 | CUAUCUCUGCUUCAAGUUG | 4487-4505 | A-1684073.1 | 928 | CAACUUGAAGCAGAGAUAG | 4487-4505 |
| AD-887400 | A-1684074.1 | 929 | AUCUCUGCUUCAAGUUGCA | 4489-4507 | A-1684075.1 | 930 | UGCAACUUGAAGCAGAGAU | 4489-4507 |

TABLE 2B-continued

Exemplary Human SCN9A Unmodified Single Strands and Duplex Sequences.
Column 1 indicates duplex name. Column 2 indicates the sense sequence name. Column 3 indicates the sequence ID for the sequence of column 4. Column 4 provides the unmodified sequence of a sense strand suitable for use in a duplex described herein. Column 5 provides the position in the target mRNA (NM_002977.3) of the sense strand of Column 4. Column 6 indicates the antisense sequence name. Column 7 indicates the sequence ID for the sequence of column 8. Column 8 provides the sequence of an antisense strand suitable for use in a duplex described herein, without specifying chemical modifications. Column 9 indicates the position in the target mRNA (NM_002977.3) that is complementary to the antisense strand of Column 8.

| Duplex Name | Sense sequence name | Seq ID NO: (sense) | Sense sequence (5'-3') | mRNA target range in NM_002977.3 | Anti sense sequence name | Seq ID NO: (anti sense) | antisense sequence (5'-3') | mRNA target range in NM_002977.3 |
|---|---|---|---|---|---|---|---|---|
| AD-887401 | A-1684076.1 | 931 | UCUCUGCUUCAAGUUGCAA | 4490-4508 | A-1684077.1 | 932 | UUGCAACUUGAAGCAGAGA | 4490-4508 |
| AD-887402 | A-1684078.1 | 933 | CUCUGCUUCAAGUUGCAAC | 4491-4509 | A-1684079.1 | 934 | GUUGCAACUUGAAGCAGAG | 4491-4509 |
| AD-887403 | A-1684080.1 | 935 | UCUGCUUCAAGUUGCAACU | 4492-4510 | A-1684081.1 | 936 | AGUUGCAACUUGAAGCAGA | 4492-4510 |
| AD-887404 | A-1684082.1 | 937 | UAUCAUCUUUGGGUCAUUC | 4618-4636 | A-1684083.1 | 938 | GAAUGACCCAAAGAUGAUA | 4618-4636 |
| AD-887405 | A-1684084.1 | 939 | AUCAUCUUUGGGUCAUUCU | 4619-4637 | A-1684085.1 | 940 | AGAAUGACCCAAAGAUGAU | 4619-4637 |
| AD-887406 | A-1684086.1 | 941 | UCAUCUUUGGGUCAUUCUU | 4620-4638 | A-1684087.1 | 942 | AAGAAUGACCCAAAGAUGA | 4620-4638 |
| AD-887407 | A-1684088.1 | 943 | CAUCUUUGGGUCAUUCUUC | 4621-4639 | A-1684089.1 | 944 | GAAGAAUGACCCAAAGAUG | 4621-4639 |
| AD-887408 | A-1684090.1 | 945 | CUUUGGGUCAUUCUUCACU | 4624-4642 | A-1684091.1 | 946 | AGUGAAGAAUGACCCAAAG | 4624-4642 |
| AD-887409 | A-1684092.1 | 947 | UUGGGUCAUUCUUCACUUU | 4626-4644 | A-1684093.1 | 948 | AAAGUGAAGAAUGACCCAA | 4626-4644 |
| AD-887410 | A-1684094.1 | 949 | UGGGUCAUUCUUCACUUUG | 4627-4645 | A-1684095.1 | 950 | CAAAGUGAAGAAUGACCCA | 4627-4645 |
| AD-887411 | A-1684096.1 | 951 | GGGUCAUUCUUCACUUUGA | 4628-4646 | A-1684097.1 | 952 | UCAAAGUGAAGAAUGACCC | 4628-4646 |
| AD-887412 | A-1684098.1 | 953 | GGUCAUUCUUCACUUUGAA | 4629-4647 | A-1684099.1 | 954 | UUCAAAGUGAAGAAUGACC | 4629-4647 |
| AD-887413 | A-1684100.1 | 955 | GUCAUUCUUCACUUUGAAC | 4630-4648 | A-1684101.1 | 956 | GUUCAAAGUGAAGAAUGAC | 4630-4648 |

TABLE 2B-continued

Exemplary Human SCN9A Unmodified Single Strands and Duplex Sequences.
Column 1 indicates duplex name. Column 2 indicates the sense sequence name. Column 3 indicates the sequence ID for the sequence of column 4. Column 4 provides the unmodified sequence of a sense strand suitable for use in a duplex described herein. Column 5 provides the position in the target mRNA (NM_002977.3) of the sense strand of Column 4. Column 6 indicates the antisense sequence name. Column 7 indicates the sequence ID for the sequence of column 8. Column 8 provides the sequence of an antisense strand suitable for use in a duplex described herein, without specifying chemical modifications. Column 9 indicates the position in the target mRNA (NM_002977.3) that is complementary to the antisense strand of Column 8.

| Duplex Name | Sense sequence name | Seq ID NO: (sense) | Sense sequence (5'-3') | mRNA target range in NM_002977.3 | Anti sense sequence name | Seq ID NO: (anti sense) | antisense sequence (5'-3') | mRNA target range in NM_002977.3 |
|---|---|---|---|---|---|---|---|---|
| AD-887414 | A-1684102.1 | 957 | CAUUCUUCACUUUGAACUU | 4632-4650 | A-1684103.1 | 958 | AAGUUCAAAGUGAAGAAUG | 4632-4650 |
| AD-887415 | A-1684104.1 | 959 | UCACUUUGAACUUGUUCAU | 4638-4656 | A-1684105.1 | 960 | AUGAACAAGUUCAAAGUGA | 4638-4656 |
| AD-887416 | A-1684106.1 | 961 | CUUGUUCAUUGGUGUCAUC | 4648-4666 | A-1684107.1 | 962 | GAUGACACCAAUGAACAAG | 4648-4666 |
| AD-887417 | A-1684108.1 | 963 | GUGUCAUCAUAGAUAAUUU | 4659-4677 | A-1684109.1 | 964 | AAAUUAUCUAUGAUGACAC | 4659-4677 |
| AD-887418 | A-1684110.1 | 965 | UGUCAUCAUAGAUAAUUUC | 4660-4678 | A-1684111.1 | 966 | GAAAUUAUCUAUGAUGACA | 4660-4678 |
| AD-887419 | A-1684112.1 | 967 | GAGGUCAAGACAUCUUUAU | 4701-4719 | A-1684113.1 | 968 | AUAAAGAUGUCUUGACCUC | 4701-4719 |
| AD-887420 | A-1684114.1 | 969 | AGGUCAAGACAUCUUUAUG | 4702-4720 | A-1684115.1 | 970 | CAUAAAGAUGUCUUGACCU | 4702-4720 |
| AD-887421 | A-1684116.1 | 971 | GGUCAAGACAUCUUUAUGA | 4703-4721 | A-1684117.1 | 972 | UCAUAAAGAUGUCUUGACC | 4703-4721 |
| AD-887422 | A-1684118.1 | 973 | CCACAAAAGCCAAUUCCUC | 4775-4793 | A-1684119.1 | 974 | GAGGAAUUGGCUUUUGUGG | 4775-4793 |
| AD-887423 | A-1684120.1 | 975 | GACCUAGUGACAAAUCAAG | 4826-4844 | A-1684121.1 | 976 | CUUGAUUUGUCACUAGGUC | 4826-4844 |
| AD-887424 | A-1684122.1 | 977 | GUAUCAUGGUUCUUAUCUG | 4857-4875 | A-1684123.1 | 978 | CAGAUAAGAACCAUGAUAC | 4857-4875 |
| AD-887425 | A-1684124.1 | 979 | UAUCAUGGUUCUUAUCUGU | 4858-4876 | A-1684125.1 | 980 | ACAGAUAAGAACCAUGAUA | 4858-4876 |
| AD-887426 | A-1684126.1 | 981 | UCAUGGUUCUUAUCUGUCU | 4860-4878 | A-1684127.1 | 982 | AGACAGAUAAGAACCAUGA | 4860-4878 |

TABLE 2B-continued

Exemplary Human SCN9A Unmodified Single Strands and Duplex Sequences.
Column 1 indicates duplex name. Column 2 indicates the sense sequence name. Column 3 indicates the sequence ID for the sequence of column 4. Column 4 provides the unmodified sequence of a sense strand suitable for use in a duplex described herein. Column 5 provides the position in the target mRNA (NM_002977.3) of the sense strand of Column 4. Column 6 indicates the antisense sequence name. Column 7 indicates the sequence ID for the sequence of column 8. Column 8 provides the sequence of an antisense strand suitable for use in a duplex described herein, without specifying chemical modifications. Column 9 indicates the position in the target mRNA (NM_002977.3) that is complementary to the antisense strand of Column 8.

| Duplex Name | Sense sequence name | Seq ID NO: (sense) | Sense sequence (5'-3') | mRNA target range in NM_002977.3 | Anti sense sequence name | Seq ID NO: (anti sense) | antisense sequence (5'-3') | mRNA target range in NM_002977.3 |
|---|---|---|---|---|---|---|---|---|
| AD-887427 | A-1684128.1 | 983 | CAUGGUUCUUAUCUGUCUC | 4861-4879 | A-1684129.1 | 984 | GAGACAGAUAAGAACCAUG | 4861-4879 |
| AD-887428 | A-1684130.1 | 985 | AUGGUUCUUAUCUGUCUCA | 4862-4880 | A-1684131.1 | 986 | UGAGACAGAUAAGAACCAU | 4862-4880 |
| AD-887429 | A-1684132.1 | 987 | UGGUUCUUAUCUGUCUCAA | 4863-4881 | A-1684133.1 | 988 | UUGAGACAGAUAAGAACCA | 4863-4881 |
| AD-887430 | A-1684134.1 | 989 | GGUUCUUAUCUGUCUCAAC | 4864-4882 | A-1684135.1 | 990 | GUUGAGACAGAUAAGAACC | 4864-4882 |
| AD-887431 | A-1684136.1 | 991 | GUUCUUAUCUGUCUCAACA | 4865-4883 | A-1684137.1 | 992 | UGUUGAGACAGAUAAGAAC | 4865-4883 |
| AD-887432 | A-1684138.1 | 993 | UCUUAUCUGUCUCAACAUG | 4867-4885 | A-1684139.1 | 994 | CAUGUUGAGACAGAUAAGA | 4867-4885 |
| AD-887433 | A-1684140.1 | 995 | AUCUGUCUCAACAUGGUAA | 4871-4889 | A-1684141.1 | 996 | UUACCAUGUUGAGACAGAU | 4871-4889 |
| AD-887434 | A-1684142.1 | 997 | UCUGUCUCAACAUGGUAAC | 4872-4890 | A-1684143.1 | 998 | GUUACCAUGUUGAGACAGA | 4872-4890 |
| AD-887435 | A-1684144.1 | 999 | CUGUCUCAACAUGGUAACC | 4873-4891 | A-1684145.1 | 1000 | GGUUACCAUGUUGAGACAG | 4873-4891 |
| AD-887436 | A-1684146.1 | 1001 | UCCUGGUCAUGUUCAUCUA | 5253-5271 | A-1684147.1 | 1002 | UAGAUGAACAUGACCAGGA | 5253-5271 |
| AD-887437 | A-1684148.1 | 1003 | AGUUCAUCCUGGAAGUUCA | 5455-5473 | A-1684149.1 | 1004 | UGAACUUCCAGGAUGAACU | 5455-5473 |
| AD-887438 | A-1684150.1 | 1005 | CCAUCUGUUGGAAUAUUCU | 5495-5513 | A-1684151.1 | 1006 | AGAAUAUUCCAACAGAUGG | 5495-5513 |
| AD-887439 | A-1684152.1 | 1007 | CAUCUGUUGGAAUAUUCUA | 5496-5514 | A-1684153.1 | 1008 | UAGAAUAUUCCAACAGAUG | 5496-5514 |

TABLE 2B-continued

Exemplary Human SCN9A Unmodified Single Strands and Duplex Sequences. Column 1 indicates duplex name. Column 2 indicates the sense sequence name. Column 3 indicates the sequence ID for the sequence of column 4. Column 4 provides the unmodified sequence of a sense strand suitable for use in a duplex described herein. Column 5 provides the position in the target mRNA (NM_002977.3) of the sense strand of Column 4. Column 6 indicates the antisense sequence name. Column 7 indicates the sequence ID for the sequence of column 8. Column 8 provides the sequence of an antisense strand suitable for use in a duplex described herein, without specifying chemical modifications. Column 9 indicates the position in the target mRNA (NM_002977.3) that is complementary to the antisense strand of Column 8.

| Duplex Name | Sense sequence name | Seq ID NO: (sense) | Sense sequence (5'-3') | mRNA target range in NM_002977.3 | Anti sense sequence name | Seq ID NO: (anti sense) | antisense sequence (5'-3') | mRNA target range in NM_002977.3 |
|---|---|---|---|---|---|---|---|---|
| AD-887440 | A-1684154.1 | 1009 | UCUGUUGGAAUAUUC UACU | 5498-5516 | A-1684155.1 | 1010 | AGUAGAAUAUUC CAACAGA | 5498-5516 |
| AD-887441 | A-1684156.1 | 1011 | CAUACUGGAGAAUUU UAGU | 5572-5590 | A-1684157.1 | 1012 | ACUAAAAUUCUCC AGUAUG | 5572-5590 |
| AD-887442 | A-1684158.1 | 1013 | CUCCUCUUCUCAUAGC AAA | 5730-5748 | A-1684159.1 | 1014 | UUUGCUAUGAGA AGAGGAG | 5730-5748 |
| AD-887443 | A-1684160.1 | 1015 | UCCUCUUCUCAUAGCA AAA | 5731-5749 | A-1684161.1 | 1016 | UUUUGCUAUGAG AAGAGGA | 5731-5749 |
| AD-887444 | A-1684162.1 | 1017 | CCUCUUCUCAUAGCAA AAC | 5732-5750 | A-1684163.1 | 1018 | GUUUUGCUAUGA GAAGAGG | 5732-5750 |
| AD-887445 | A-1684164.1 | 1019 | CUCUUCUCAUAGCAAA ACC | 5733-5751 | A-1684165.1 | 1020 | GGUUUUGCUAUG AGAAGAG | 5733-5751 |
| AD-887446 | A-1684166.1 | 1021 | GAUCCAUUGUCUUGAC AUC | 5803-5821 | A-1684167.1 | 1022 | GAUGUCAAGACA AUGGAUC | 5803-5821 |
| AD-887447 | A-1684168.1 | 1023 | AUCCAUUGUCUUGACA UCU | 5804-5822 | A-1684169.1 | 1024 | AGAUGUCAAGAC AAUGGAU | 5804-5822 |
| AD-887448 | A-1684170.1 | 1025 | UCCAUUGUCUUGACAU CUU | 5805-5823 | A-1684171.1 | 1026 | AAGAUGUCAAGA CAAUGGA | 5805-5823 |
| AD-887449 | A-1684172.1 | 1027 | CAUUGUCUUGACAUCU UAU | 5807-5825 | A-1684173.1 | 1028 | AUAAGAUGUCAA GACAAUG | 5807-5825 |
| AD-887450 | A-1684174.1 | 1029 | UUGUCUUGACAUCUU AUUU | 5809-5827 | A-1684175.1 | 1030 | AAAUAAGAUGUC AAGACAA | 5809-5827 |
| AD-887451 | A-1684176.1 | 1031 | UGUCUUGACAUCUUA UUUG | 5810-5828 | A-1684177.1 | 1032 | CAAAUAAGAUGU CAAGACA | 5810-5828 |
| AD-887452 | A-1684178.1 | 1033 | GUCUUGACAUCUUAU UUGC | 5811-5829 | A-1684179.1 | 1034 | GCAAAUAAGAUG UCAAGAC | 5811-5829 |

TABLE 2B-continued

Exemplary Human SCN9A Unmodified Single Strands and Duplex Sequences.
Column 1 indicates duplex name. Column 2 indicates the sense sequence name. Column 3 indicates the sequence ID for the sequence of column 4. Column 4 provides the unmodified sequence of a sense strand suitable for use in a duplex described herein. Column 5 provides the position in the target mRNA (NM_002977.3) of the sense strand of Column 4. Column 6 indicates the antisense sequence name. Column 7 indicates the sequence ID for the sequence of column 8. Column 8 provides the sequence of an antisense strand suitable for use in a duplex described herein, without specifying chemical modifications. Column 9 indicates the position in the target mRNA (NM_002977.3) that is complementary to the antisense strand of Column 8.

| Duplex Name | Sense sequence name | Seq ID NO: (sense) | Sense sequence (5'-3') | mRNA target range in NM_002977.3 | Anti sense sequence name | Seq ID NO: (anti sense) | antisense sequence (5'-3') | mRNA target range in NM_002977.3 |
|---|---|---|---|---|---|---|---|---|
| AD-887453 | A-1684180.1 | 1035 | GGAGAUGGAUUCUCUUCGU | 5860-5878 | A-1684181.1 | 1036 | ACGAAGAGAAUCCAUCUCC | 5860-5878 |
| AD-887454 | A-1684182.1 | 1037 | GAGAUGGAUUCUCUUCGUU | 5861-5879 | A-1684183.1 | 1038 | AACGAAGAGAAUCCAUCUC | 5861-5879 |
| AD-887455 | A-1684184.1 | 1039 | AGAUGGAUUCUCUUCGUUC | 5862-5880 | A-1684185.1 | 1040 | GAACGAAGAGAAUCCAUCU | 5862-5880 |
| AD-887456 | A-1684186.1 | 1041 | GAUGGAUUCUCUUCGUUCA | 5863-5881 | A-1684187.1 | 1042 | UGAACGAAGAGAAUCCAUC | 5863-5881 |
| AD-887457 | A-1684188.1 | 1043 | AUGGAUUCUCUUCGUUCAC | 5864-5882 | A-1684189.1 | 1044 | GUGAACGAAGAGAAUCCAU | 5864-5882 |
| AD-887458 | A-1684190.1 | 1045 | UGGAUUCUCUUCGUUCACA | 5865-5883 | A-1684191.1 | 1046 | UGUGAACGAAGAGAAUCCA | 5865-5883 |
| AD-887459 | A-1684192.1 | 1047 | GGAUUCUCUUCGUUCACAG | 5866-5884 | A-1684193.1 | 1048 | CUGUGAACGAAGAGAAUCC | 5866-5884 |
| AD-887460 | A-1684194.1 | 1049 | GAUUCUCUUCGUUCACAGA | 5867-5885 | A-1684195.1 | 1050 | UCUGUGAACGAAGAGAAUC | 5867-5885 |
| AD-887461 | A-1684196.1 | 1051 | UUCUCUUCGUUCACAGAUG | 5869-5887 | A-1684197.1 | 1052 | CAUCUGUGAACGAAGAGAA | 5869-5887 |
| AD-887462 | A-1684198.1 | 1053 | UCUCUUCGUUCACAGAUGG | 5870-5888 | A-1684199.1 | 1054 | CCAUCUGUGAACGAAGAGA | 5870-5888 |
| AD-887463 | A-1684200.1 | 1055 | CUCUUCGUUCACAGAUGGA | 5871-5889 | A-1684201.1 | 1056 | UCCAUCUGUGAACGAAGAG | 5871-5889 |
| AD-887464 | A-1684202.1 | 1057 | UCUUCGUUCACAGAUGGAA | 5872-5890 | A-1684203.1 | 1058 | UUCCAUCUGUGAACGAAGA | 5872-5890 |
| AD-887465 | A-1684204.1 | 1059 | AGGUUCAUGUCUGCAAAUC | 5894-5912 | A-1684205.1 | 1060 | GAUUUGCAGACAUGAACCU | 5894-5912 |

TABLE 2B-continued

Exemplary Human SCN9A Unmodified Single Strands and Duplex Sequences.
Column 1 indicates duplex name. Column 2 indicates the sense sequence name. Column 3 indicates the sequence ID for the sequence of column 4. Column 4 provides the unmodified sequence of a sense strand suitable for use in a duplex described herein. Column 5 provides the position in the target mRNA (NM_002977.3) of the sense strand of Column 4. Column 6 indicates the antisense sequence name. Column 7 indicates the sequence ID for the sequence of column 8. Column 8 provides the sequence of an antisense strand suitable for use in a duplex described herein, without specifying chemical modifications. Column 9 indicates the position in the target mRNA (NM_002977.3) that is complementary to the antisense strand of Column 8.

| Duplex Name | Sense sequence name | Seq ID NO: (sense) | Sense sequence (5'-3') | mRNA target range in NM_002977.3 | Anti sense sequence name | Seq ID NO: (anti sense) | antisense sequence (5'-3') | mRNA target range in NM_002977.3 |
|---|---|---|---|---|---|---|---|---|
| AD-887466 | A-1684206.1 | 1061 | UCUGCAAAUCCUUCCA AAG | 5903-5921 | A-1684207.1 | 1062 | CUUUGGAAGGAU UUGCAGA | 5903-5921 |
| AD-887467 | A-1684208.1 | 1063 | CUGCAAAUCCUUCCAA AGU | 5904-5922 | A-1684209.1 | 1064 | ACUUUGGAAGGA UUUGCAG | 5904-5922 |
| AD-887468 | A-1684210.1 | 1065 | GUGUCUGCUACUGUC AUUC | 5969-5987 | A-1684211.1 | 1066 | GAAUGACAGUAG CAGACAC | 5969-5987 |
| AD-887469 | A-1684212.1 | 1067 | UGUCUGCUACUGUCA UUCA | 5970-5988 | A-1684213.1 | 1068 | UGAAUGACAGUA GCAGACA | 5970-5988 |
| AD-887470 | A-1684214.1 | 1069 | GUCUGCUACUGUCAU UCAG | 5971-5989 | A-1684215.1 | 1070 | CUGAAUGACAGU AGCAGAC | 5971-5989 |
| AD-887471 | A-1684216.1 | 1071 | ACCGCUUAAGGCAAAA UGU | 6006-6024 | A-1684217.1 | 1072 | ACAUUUUGCCUU AAGCGGU | 6006-6024 |
| AD-887472 | A-1684218.1 | 1073 | CCGCUUAAGGCAAAAU GUC | 6007-6025 | A-1684219.1 | 1074 | GACAUUUUGCCU UAAGCGG | 6007-6025 |
| AD-887473 | A-1684220.1 | 1075 | UCUCCACCUUCAUAUG AUA | 6158-6176 | A-1684221.1 | 1076 | UAUCAUAUGAAG GUGGAGA | 6158-6176 |
| AD-887474 | A-1684222.1 | 1077 | UGCCAAAAUCCUUUUU AUC | 6344-6362 | A-1684223.1 | 1078 | GAUAAAAAGGAU UUUGGCA | 6344-6362 |
| AD-887475 | A-1684224.1 | 1079 | GCCAAAAUCCUUUUUA UCA | 6345-6363 | A-1684225.1 | 1080 | UGAUAAAAAGGA UUUUGGC | 6345-6363 |
| AD-887476 | A-1684226.1 | 1081 | UCGUAAGAGAACUCUG UAG | 6463-6481 | A-1684227.1 | 1082 | CUACAGAGUUCU CUUACGA | 6463-6481 |
| AD-887477 | A-1684228.1 | 1083 | UCUGCCUUGUCAUCUU UUC | 6563-6581 | A-1684229.1 | 1084 | GAAAAGAUGACA AGGCAGA | 6563-6581 |
| AD-887478 | A-1684230.1 | 1087 | CUGCCUUGUCAUCUUU UCA | 6564-6582 | A-1684231.1 | 1086 | UGAAAAGAUGAC AAGGCAG | 6564-6582 |

TABLE 2B-continued

Exemplary Human SCN9A Unmodified Single Strands and Duplex Sequences.
Column 1 indicates duplex name. Column 2 indicates the sense sequence name. Column 3 indicates the sequence ID for the sequence of column 4. Column 4 provides the unmodified sequence of a sense strand suitable for use in a duplex described herein. Column 5 provides the position in the target mRNA (NM_002977.3) of the sense strand of Column 4. Column 6 indicates the antisense sequence name. Column 7 indicates the sequence ID for the sequence of column 8. Column 8 provides the sequence of an antisense strand suitable for use in a duplex described herein, without specifying chemical modifications. Column 9 indicates the position in the target mRNA (NM_002977.3) that is complementary to the antisense strand of Column 8.

| Duplex Name | Sense sequence name | Seq ID NO: (sense) | Sense sequence (5'-3') | mRNA target range in NM_002977.3 | Anti sense sequence name | Seq ID NO: (anti sense) | antisense sequence (5'-3') | mRNA target range in NM_002977.3 |
|---|---|---|---|---|---|---|---|---|
| AD-887479 | A-1684232.1 | 1085 | UGCCUUGUCAUCUUUUCAC | 6565-6583 | A-1684233.1 | 1088 | GUGAAAAGAUGACAAGGCA | 6565-6583 |
| AD-887480 | A-1684234.1 | 1089 | GCCUUGUCAUCUUUUCACA | 6566-6584 | A-1684235.1 | 1090 | UGUGAAAAGAUGACAAGGC | 6566-6584 |
| AD-887481 | A-1684236.1 | 1091 | CCUUGUCAUCUUUUCACAG | 6567-6585 | A-1684237.1 | 1092 | CUGUGAAAAGAUGACAAGG | 6567-6585 |
| AD-887482 | A-1684238.1 | 1093 | CAUCUUUUCACAGGAUUGU | 6573-6591 | A-1684239.1 | 1094 | ACAAUCCUGUGAAAAGAUG | 6573-6591 |
| AD-887483 | A-1684240.1 | 1095 | CCCAUGUAAAUAAACAACA | 6606-6624 | A-1684241.1 | 1096 | UGUUGUUUAUUUACAUGGG | 6606-6624 |
| AD-887484 | A-1684242.1 | 1097 | CAUUCAUCUUGACUCACAU | 6911-6929 | A-1684243.1 | 1098 | AUGUGAGUCAAGAUGAAUG | 6911-6929 |
| AD-887485 | A-1684244.1 | 1099 | ACAUAUUACACUCCUCAAA | 7040-7058 | A-1684245.1 | 1100 | UUUGAGGAGUGUAAUAUGU | 7040-7058 |
| AD-887486 | A-1684246.1 | 1101 | CAUAUUACACUCCUCAAAA | 7041-7059 | A-1684247.1 | 1102 | UUUUGAGGAGUGUAAUAUG | 7041-7059 |
| AD-887487 | A-1684248.1 | 1103 | UGCCCAAAAUACUGAUAAU | 7140-7158 | A-1684249.1 | 1104 | AUUAUCAGUAUUUUGGGCA | 7140-7158 |
| AD-887488 | A-1684250.1 | 1105 | GCCCAAAAUACUGAUAAUA | 7141-7159 | A-1684251.1 | 1106 | UAUUAUCAGUAUUUUGGGC | 7141-7159 |
| AD-887489 | A-1684252.1 | 1107 | CUGAUAAUAGUCUCUUAAA | 7151-7169 | A-1684253.1 | 1108 | UUUAAGAGACUAUUAUCAG | 7151-7169 |
| AD-887490 | A-1684254.1 | 1109 | GUCAAAUUUUCCUGCUUUC | 7177-7195 | A-1684255.1 | 1110 | GAAAGCAGGAAAAUUUGAC | 7177-7195 |
| AD-887491 | A-1684256.1 | 1111 | UCAAAUUUUCCUGCUUUCU | 7178-7196 | A-1684257.1 | 1112 | AGAAAGCAGGAAAAUUUGA | 7178-7196 |

TABLE 2B-continued

Exemplary Human SCN9A Unmodified Single Strands and Duplex Sequences.
Column 1 indicates duplex name. Column 2 indicates the sense sequence name. Column 3 indicates the sequence ID for the sequence of column 4. Column 4 provides the unmodified sequence of a sense strand suitable for use in a duplex described herein. Column 5 provides the position in the target mRNA (NM_002977.3) of the sense strand of Column 4. Column 6 indicates the antisense sequence name. Column 7 indicates the sequence ID for the sequence of column 8. Column 8 provides the sequence of an antisense strand suitable for use in a duplex described herein, without specifying chemical modifications. Column 9 indicates the position in the target mRNA (NM_002977.3) that is complementary to the antisense strand of Column 8.

| Duplex Name | Sense sequence name | Seq ID NO: (sense) | Sense sequence (5'-3') | mRNA target range in NM_002977.3 | Anti sense sequence name | Seq ID NO: (anti sense) | antisense sequence (5'-3') | mRNA target range in NM_002977.3 |
|---|---|---|---|---|---|---|---|---|
| AD-887492 | A-1684258.1 | 1113 | CAAAUUUUCCUGCUUUCUU | 7179-7197 | A-1684259.1 | 1114 | AAGAAAGCAGGAAAAUUUG | 7179-7197 |
| AD-887493 | A-1684260.1 | 1115 | AUUGUUUAGUCAUCCUUUC | 7205-7223 | A-1684261.1 | 1116 | GAAAGGAUGACUAAACAAU | 7205-7223 |
| AD-887494 | A-1684262.1 | 1117 | GCAUCACUUGUAUACAAUC | 7322-7340 | A-1684263.1 | 1118 | GAUUGUAUACAAGUGAUGC | 7322-7340 |
| AD-887495 | A-1684264.1 | 1119 | CACCAACUUACUUUCCUAA | 7453-7471 | A-1684265.1 | 1120 | UUAGGAAAGUAAGUUGGUG | 7453-7471 |
| AD-887496 | A-1684266.1 | 1121 | ACCAACUUACUUUCCUAAA | 7454-7472 | A-1684267.1 | 1122 | UUUAGGAAAGUAAGUUGGU | 7454-7472 |
| AD-887497 | A-1684268.1 | 1123 | CCAACUUACUUUCCUAAAU | 7455-7473 | A-1684269.1 | 1124 | AUUUAGGAAAGUAAGUUGG | 7455-7473 |
| AD-887498 | A-1684270.1 | 1125 | CAACUUACUUUCCUAAAUU | 7456-7474 | A-1684271.1 | 1126 | AAUUUAGGAAAGUAAGUUG | 7456-7474 |
| AD-887499 | A-1684272.1 | 1127 | AGGAAGAUGUCACCUUCUC | 7517-7535 | A-1684273.1 | 5814 | GAGAAGGUGACAUCUUCCU | 7517-7535 |
| AD-887500 | A-1684274.1 | 1128 | GAAGAUGUCACCUUCUCCU | 7519-7537 | A-1684275.1 | 1130 | AGGAGAAGGUGACAUCUUC | 7519-7537 |
| AD-887501 | A-1684276.1 | 1131 | AGAUGUCACCUUCUCCUUA | 7521-7539 | A-1684277.1 | 1132 | UAAGGAGAAGGUGACAUCU | 7521-7539 |
| AD-887502 | A-1684278.1 | 1133 | GAUGUCACCUUCUCCUUAA | 7522-7540 | A-1684279.1 | 1134 | UUAAGGAGAAGGUGACAUC | 7522-7540 |
| AD-887503 | A-1684280.1 | 1135 | AUGUCACCUUCUCCUUAAA | 7523-7541 | A-1684281.1 | 1136 | UUUAAGGAGAAGGUGACAU | 7523-7541 |
| AD-887504 | A-1684282.1 | 1137 | UGUCACCUUCUCCUUAAAA | 7524-7542 | A-1684283.1 | 1138 | UUUUAAGGAGAAGGUGACA | 7524-7542 |

TABLE 2B-continued

Exemplary Human SCN9A Unmodified Single Strands and Duplex Sequences.
Column 1 indicates duplex name. Column 2 indicates the sense sequence name. Column 3 indicates the sequence ID for the sequence of column 4. Column 4 provides the unmodified sequence of a sense strand suitable for use in a duplex described herein. Column 5 provides the position in the target mRNA (NM_002977.3) of the sense strand of Column 4. Column 6 indicates the antisense sequence name. Column 7 indicates the sequence ID for the sequence of column 8. Column 8 provides the sequence of an antisense strand suitable for use in a duplex described herein, without specifying chemical modifications. Column 9 indicates the position in the target mRNA (NM_002977.3) that is complementary to the antisense strand of Column 8.

| Duplex Name | Sense sequence name | Seq ID NO: (sense) | Sense sequence (5'-3') | mRNA target range in NM_002977.3 | Anti sense sequence name | Seq ID NO: (anti sense) | antisense sequence (5'-3') | mRNA target range in NM_002977.3 |
|---|---|---|---|---|---|---|---|---|
| AD-887505 | A-1684284.1 | 1139 | GUCACCUUCUCCUUAAAAU | 7525-7543 | A-1684285.1 | 1140 | AUUUUAAGGAGAAGGUGAC | 7525-7543 |
| AD-887506 | A-1684286.1 | 1141 | UCACCUUCUCCUUAAAAUU | 7526-7544 | A-1684287.1 | 1142 | AAUUUUAAGGAGAAGGUGA | 7526-7544 |
| AD-887507 | A-1684288.1 | 1143 | ACCUUCUCCUUAAAAUUCU | 7528-7546 | A-1684289.1 | 1144 | AGAAUUUUAAGGAGAAGGU | 7528-7546 |
| AD-887508 | A-1684290.1 | 1145 | CCUUCUCCUUAAAAUUCUA | 7529-7547 | A-1684291.1 | 1146 | UAGAAUUUUAAGGAGAAGG | 7529-7547 |
| AD-887509 | A-1684292.1 | 1147 | CUUCUCCUUAAAAUUCUAU | 7530-7548 | A-1684293.1 | 1148 | AUAGAAUUUUAAGGAGAAG | 7530-7548 |
| AD-887510 | A-1684294.1 | 1149 | UGAGAUCUUUCUUCUAUAA | 7721-7739 | A-1684295.1 | 1150 | UUAUAGAAGAAAGAUCUCA | 7721-7739 |
| AD-887511 | A-1684296.1 | 1151 | GAUCUUUCUUCUAUAAAGU | 7724-7742 | A-1684297.1 | 1152 | ACUUUAUAGAAGAAAGAUC | 7724-7742 |
| AD-887512 | A-1684298.1 | 1153 | UACCAUCUUAGGUUCAUUC | 8105-8123 | A-1684299.1 | 1154 | GAAUGAACCUAAGAUGGUA | 8105-8123 |
| AD-887513 | A-1684300.1 | 1155 | ACCAUCUUAGGUUCAUUCA | 8106-8124 | A-1684301.1 | 1156 | UGAAUGAACCUAAGAUGGU | 8106-8124 |
| AD-887514 | A-1684302.1 | 1157 | CCAUCUUAGGUUCAUUCAU | 8107-8125 | A-1684303.1 | 1158 | AUGAAUGAACCUAAGAUGG | 8107-8125 |
| AD-887515 | A-1684304.1 | 1159 | CAUCUUAGGUUCAUUCAUC | 8108-8126 | A-1684305.1 | 1160 | GAUGAAUGAACCUAAGAUG | 8108-8126 |
| AD-887516 | A-1684306.1 | 1161 | UCUUAGGUUCAUUCAUCUU | 8110-8128 | A-1684307.1 | 1162 | AAGAUGAAUGAACCUAAGA | 8110-8128 |
| AD-887517 | A-1684308.1 | 1163 | CUUAGGUUCAUUCAUCUUA | 8111-8129 | A-1684309.1 | 1164 | UAAGAUGAAUGAACCUAAG | 8111-8129 |

TABLE 2B-continued

Exemplary Human SCN9A Unmodified Single Strands and Duplex Sequences.
Column 1 indicates duplex name. Column 2 indicates the sense sequence name. Column 3 indicates the sequence ID for the sequence of column 4. Column 4 provides the unmodified sequence of a sense strand suitable for use in a duplex described herein. Column 5 provides the position in the target mRNA (NM_002977.3) of the sense strand of Column 4. Column 6 indicates the antisense sequence name. Column 7 indicates the sequence ID for the sequence of column 8. Column 8 provides the sequence of an antisense strand suitable for use in a duplex described herein, without specifying chemical modifications. Column 9 indicates the position in the target mRNA (NM_002977.3) that is complementary to the antisense strand of Column 8.

| Duplex Name | Sense sequence name | Seq ID NO: (sense) | Sense sequence (5'-3') | mRNA target range in NM_002977.3 | Anti sense sequence name | Seq ID NO: (anti sense) | antisense sequence (5'-3') | mRNA target range in NM_002977.3 |
|---|---|---|---|---|---|---|---|---|
| AD-887518 | A-1684310.1 | 1165 | UUAGGUUCAUUCAUCUUAG | 8112-8130 | A-1684311.1 | 1166 | CUAAGAUGAAUGAACCUAA | 8112-8130 |
| AD-887519 | A-1684312.1 | 1167 | UAGGUUCAUUCAUCUUAGG | 8113-8131 | A-1684313.1 | 1168 | CCUAAGAUGAAUGAACCUA | 8113-8131 |
| AD-887520 | A-1684314.1 | 1169 | CUGCAUUAUGAAUACUUAC | 8368-8386 | A-1684315.1 | 1170 | GUAAGUAUUCAUAAUGCAG | 8368-8386 |
| AD-887521 | A-1684316.1 | 1171 | ACACAAUUUCUUCUUAGCA | 8500-8518 | A-1684317.1 | 1172 | UGCUAAGAAGAAAUUGUGU | 8500-8518 |
| AD-887522 | A-1684318.1 | 1173 | GUUCUUUUUCCUAUUUCAU | 8541-8559 | A-1684319.1 | 1174 | AUGAAAUAGGAAAAAGAAC | 8541-8559 |
| AD-887523 | A-1684320.1 | 1175 | UCCUAUUUCAUGAACUAUG | 8549-8567 | A-1684321.1 | 1176 | CAUAGUUCAUGAAAUAGGA | 8549-8567 |
| AD-887524 | A-1684322.1 | 1177 | CCUAUUUCAUGAACUAUGU | 8550-8568 | A-1684323.1 | 1178 | ACAUAGUUCAUGAAAUAGG | 8550-8568 |
| AD-887525 | A-1684324.1 | 1179 | AUGUCUACUUGUGACUUUU | 8623-8641 | A-1684325.1 | 1180 | AAAAGUCACAAGUAGACAU | 8623-8641 |
| AD-887526 | A-1684326.1 | 1181 | UGUCUACUUGUGACUUUUU | 8624-8642 | A-1684327.1 | 1182 | AAAAAGUCACAAGUAGACA | 8624-8642 |
| AD-887527 | A-1684328.1 | 1183 | UCUACUUGUGACUUUUUAU | 8626-8644 | A-1684329.1 | 1184 | AUAAAAAGUCACAAGUAGA | 8626-8644 |

TABLE 2B-continued

Exemplary Human SCN9A Unmodified Single Strands and Duplex Sequences.
Column 1 indicates duplex name. Column 2 indicates the sense sequence name. Column 3 indicates the sequence ID for the sequence of column 4. Column 4 provides the unmodified sequence of a sense strand suitable for use in a duplex described herein. Column 5 provides the position in the target mRNA (NM_002977.3) of the sense strand of Column 4. Column 6 indicates the antisense sequence name. Column 7 indicates the sequence ID for the sequence of column 8. Column 8 provides the sequence of an antisense strand suitable for use in a duplex described herein, without specifying chemical modifications. Column 9 indicates the position in the target mRNA (NM_002977.3) that is complementary to the antisense strand of Column 8.

| Duplex Name | Sense sequence name | Seq ID NO: (sense) | Sense sequence (5'-3') | mRNA target range in NM_002977.3 | Anti sense sequence name | Seq ID NO: (anti sense) | antisense sequence (5'-3') | mRNA target range in NM_002977.3 |
|---|---|---|---|---|---|---|---|---|
| AD-887528 | A-1684330.1 | 1185 | CUACUUGUGACUUUUUAUC | 8627-8645 | A-1684331.1 | 5815 | GAUAAAAAGUCACAAGUAG | 8627-8645 |
| AD-887529 | A-1684332.1 | 1186 | GUUCUAAAUAGCUAUUUCA | 9384-9402 | A-1684333.1 | 1188 | UGAAAUAGCUAUUUAGAAC | 9384-9402 |
| AD-887530 | A-1684334.1 | 1189 | GCUGUUUACAUAGGAUUCU | 9600-9618 | A-1684335.1 | 1190 | AGAAUCCUAUGUAAACAGC | 9600-9618 |
| AD-887531 | A-1684336.1 | 1191 | GCUCAAAAUGUUUGAGUUU | 9644-9662 | A-1684337.1 | 1192 | AAACUCAAACAUUUUGAGC | 9644-9662 |

TABLE 4A

Exemplary Human SCN9A siRNA Modified Single Strands and Duplex Sequences
Column 1 indicates duplex name and the number following the decimal point in a duplex name merely refers to a batch production number. Column 2 indicates the name of the sense sequence. Column 3 indicates the sequence ID for the sequence of column 4. Column 4 provides the modified sequence of a sense strand suitable for use in a duplex described herein. Column 5 indicates the antisense sequence name. Column 6 indicates the sequence ID for the sequence of column 7. Column 7 provides the sequence of a modified antisense strand suitable for use in a duplex described herein, e.g., a duplex comprising the sense sequence in the same row of the table. Column 8 indicates the position in the target mRNA (NM_001365536.1) that is complementary to the antisense strand of Column 7. Column 9 indicated the sequence ID for the sequence of column 8.

| Duplex Name | Sense sequence name | Seq ID NO: (sense) | Sense sequence (5'-3') | Antisense sequence name | Seq ID NO: (anti sense) | Antisense sequence (5'-3') | mRNA target sequence in NM_001365536.1 | Seq ID NO: (mRNA target) |
|---|---|---|---|---|---|---|---|---|
| AD-796825.1 | A-1525636.1 | 1795 | ususugu(Ahd)GfaUfCfUfugcaauuacaL96 | A-1257916.1 | 1796 | VPusGfsuaaUfuGfCfaagaUfcUfacaaasasg | CUUUUGUAGAUCUUGCAAUUACC | 3339 |
| AD-795366.1 | A-1522818.1 | 1797 | ususcug(Uhd)GfuAfGfGfagaauucacaL96 | A-1522819.1 | 1798 | VPusGfsugaAfuUfCfuccuAfcAfcagaasgsc | GCUUCUGUGUAGGAGAAUUCACU | 3340 |
| AD-797565.2 | A-1527044.1 | 1799 | asusgug(Ahd)AfaCfAfAfaccuuacguaL96 | A-1527045.1 | 1800 | VPusAfscguAfaGfGfuuugUfuUfcacausasa | UUAUGUGAAACAAACCUUACGUG | 3341 |
| AD-795371.1 | A-1522828.1 | 1801 | usgsuag(Ghd)AfgAfAfUfucacuuuucaL96 | A-1522829.1 | 1802 | VPusGfsaaaAfgUfGfaauuCfuCfcuacascsa | UGUGUAGGAGAAUUCACUUUUCU | 3342 |
| AD-797564.2 | A-1527042.1 | 1803 | usasugu(Ghd)AfaAfCfAfaaccuuacgaL96 | A-1527043.1 | 1804 | VPusCfsguaAfgGfUfuuguUfuCfacauasasu | AUUAUGUGAAACAAACCUUACGU | 3343 |
| AD-795634.2 | A-1523299.1 | 1805 | asgscau(Ahd)AfaUfGfUfuuucgaaauaL96 | A-1523300.1 | 1806 | VPusAfsuuuCfgAfAfaacaUfuUfaugcUSUSC | GAAGCAUAAAUGUUUUCGAAAUU | 3344 |
| AD-795913.1 | A-1523849.1 | 1807 | gsasucu(Uhd)CfuUfUfGfucguagugaaL96 | A-1523850.1 | 1808 | VPusUfscacUfaCfGfacaaAfgAfagaucsasu | AUGAUCUUCUUUGUCGUAGUGAU | 3345 |
| AD-796618.1 | A-1525247.1 | 1809 | gsgscgu(Uhd)GfuAfGfUfuccuaucucaL96 | A-1525248.1 | 1810 | VPusGfsagaUfaGfGfaacuAfcAfacgccsusu | AAGGCGUUGUAGUUCCUAUCUCC | 3346 |
| AD-795914.1 | A-1523851.1 | 1811 | asuscuu(Chd)UfuUfGfUfcguagugauaL96 | A-1523852.1 | 1812 | VPusAfsucaCfuAfCfgacaAfaGfaagauscsa | UGAUCUUCUUUGUCGUAGUGAUU | 3347 |
| AD- | A- | 1813 | usgsguu(Uhd)CfaGf | A- | 1814 | VPusCfsugaAfuCf | UGUGGUUUCAGCACA | 3348 |

TABLE 4A-continued

Exemplary Human SCN9A siRNA Modified Single Strands and Duplex Sequences
Column 1 indicates duplex name and the number following the decimal point in a duplex name merely refers to a batch production number. Column 2 indicates the name of the sense sequence. Column 3 indicates the sequence ID for the sequence of column 4. Column 4 provides the modified sequence of a sense strand suitable for use in a duplex described herein. Column 5 indicates the antisense sequence name. Column 6 indicates the sequence ID for the sequence of column 7. Column 7 provides the sequence of a modified antisense strand suitable for use in a duplex described herein, e.g., a duplex comprising the sense sequence in the same row of the table. Column 8 indicates the position in the target mRNA (NM_001365536.1) that is complementary to the antisense strand of Column 7. Column 9 indicated the sequence ID for the sequence of column 8.

| Duplex Name | Sense sequence name | Seq ID NO: (sense) | Sense sequence (5'-3') | Antisense sequence name | Seq ID NO: (anti sense) | Antisense sequence (5'-3') | mRNA target sequence in NM_001365536.1 | Seq ID NO: (mRNA target) |
|---|---|---|---|---|---|---|---|---|
| 795739.1 | 1523509.1 | | CfAfcagauucagaL96 | 1523510.1 | | UfgugcUfgAfaacc ascsa | GAUUCAGG | |
| AD-795305.1 | A-1522697.1 | 1815 | usgsucg(Ahd)GfuAf CfAfcuuuuacugaL96 | A-1522698.1 | 1816 | VPusCfsaguAfaAf AfguguAfcUfcgac asusu | AAUGUCGAGUACACUU UUACUGG | 3349 |
| AD-797636.2 | A-1527186.1 | 1817 | asasgca(Ghd)AfaGf AfUfcugaauacuaL96 | A-1527187.1 | 1818 | VPusAfsguaUfuCf AfgaucUfuCfugcu usgsu | ACAAGCAGAAGAUCUG AAUACUA | 3350 |
| AD-802471.2 | A-1536717.1 | 1819 | csasagu(Ghd)UfuCf CfUfacugucaugaL96 | A-1536718.1 | 1820 | VPusCfsaugAfcAf GfuaggAfaCfacuu gsasa | UUCAAGUGUUCCUACU GUCAUGA | 3351 |
| AD-796209.1 | A-1524439.1 | 1821 | asusgcu(Ghd)AfgAf AfAfuugucgaaaaL96 | A-1524440.1 | 1822 | VPusUfsuucGfaCf AfauuuCfuCfagca uscsu | AGAUGCUGAGAAAUU GUCGAAAU | 3352 |
| AD-799223.1 | A-1530270.1 | 1823 | asusguu(Uhd)CfuAf GfCfugauuugauaL96 | A-1530271.1 | 1824 | VPusAfsucaAfaUf CfagcuAfgAfaaca usasc | GUAUGUUUCUAGCUG AUUUGAUU | 3353 |
| AD-799938.1 | A-1531655.1 | 1825 | gsasgau(Ghd)GfaUf UfCfucuucguucaL96 | A-1531656.1 | 1826 | VPusGfsaacGfaAf GfagaaUfcCfaucu cscsc | GGGAGAUGGAUUCUC UUCGUUCA | 3354 |
| AD-797036.1 | A-1526036.1 | 1827 | ususgug(Ahd)CfuUf UfAfaguuuagugaL96 | A-1526037.1 | 1828 | VPusCfsacuAfaAf CfuuaaAfgUfcaca asusa | UAUUGUGACUUUAAG UUUAGUGG | 3355 |
| AD-795911.1 | A-1523845.1 | 1829 | asusgau(Chd)UfuCf UfUfugucguaguaL96 | A-1523846.1 | 1830 | VPusAfscuaCfgAf CfaaagAfaGfauca usgsu | ACAUGAUCUUCUUUG UCGUAGUG | 3356 |
| AD-795132.1 | A-1522351.1 | 1831 | asasggg(Ahd)AfaAf CfAfaucuuccguaL96 | A-1522352.1 | 1832 | VPusAfscggAfaGf AfuuguUfuUfcccu ususg | CAAAGGGAAAACAAUC UUCCGUU | 3357 |

TABLE 4A-continued

Exemplary Human SCN9A siRNA Modified Single Strands and Duplex Sequences
Column 1 indicates duplex name and the number following the decimal point in a duplex name merely refers to a batch production number. Column 2 indicates the name of the sense sequence. Column 3 indicates the sequence ID for the sequence of column 4. Column 4 provides the modified sequence of a sense strand suitable for use in a duplex described herein. Column 5 indicates the antisense sequence name. Column 6 indicates the sequence ID for the sequence of column 7. Column 7 provides the sequence of a modified antisense strand suitable for use in a duplex described herein, e.g., a duplex comprising the sense sequence in the same row of the table. Column 8 indicates the position in the target mRNA (NM_001365536.1) that is complementary to the antisense strand of Column 7. Column 9 indicated the sequence ID for the sequence of column 8.

| Duplex Name | Sense sequence name | Seq ID NO: (sense) | Sense sequence (5'-3') | Antisense sequence name | Seq ID NO: (anti sense) | Antisense sequence (5'-3') | mRNA target sequence in NM_001365536.1 | Seq ID NO: (mRNA target) |
|---|---|---|---|---|---|---|---|---|
| AD-796138.1 | A-1524297.1 | 1833 | csusucu(Ghd)AfaAfCfAfuccaaacugaL96 | A-1524298.1 | 1834 | VPusCfsaguUfuGfGfauguUfuCfagaagsasa | UUCUUCUGAAACAUCCAAACUGA | 3358 |
| AD-796919.1 | A-1525802.1 | 1835 | ususgcu(Ahd)UfaGfGfAfaauuuggucaL96 | A-1525803.1 | 1836 | VPusGfsaccAfaAfUfuuccUfaUfagcaasgsu | ACUUGCUAUAGGAAAUUUGGUCU | 3359 |
| AD-797034.1 | A-1526032.1 | 1837 | usasuug(Uhd)GfaCfUfUfuaaguuuagaL96 | A-1526033.1 | 1838 | VPusCfsuaaAfcUfUfaaagUfcAfcaauasasg | CUUAUUGUGACUUUAAGUUUAGU | 3360 |
| AD-795774.1 | A-1523579.1 | 1839 | ususggc(Ahd)GfaAfAfCfccugauuauaL96 | A-1523580.1 | 1840 | VPusAfsuaaUfcAfGfgguuUfcUfgccaasusu | AAUUGGCAGAAACCCUGAUUAUG | 3361 |
| AD-795909.1 | A-1523841.1 | 1841 | ascsaug(Ahd)UfcUfUfCfuuugucguaaL96 | A-1523842.1 | 1842 | VPusUfsacgAfcAfAfagaaGfaUfcaugusasg | CUACAUGAUCUUCUUUGUCGUAG | 3362 |
| AD-802123.1 | A-1536023.1 | 1843 | asgscuu(Ghd)AfaGfUfAfaaauuagacaL96 | A-1536024.1 | 1844 | VPusGfsucuAfaUfUfuuacUfuCfaagcususa | UAAGCUUGAAGUAAAAUUAGACC | 3363 |
| AD-798588.2 | A-1529045.1 | 1845 | uscscaa(Ahd)UfcGfUfUfccgaauguuaL96 | A-1529046.1 | 1846 | VPusAfsacaUfuCfGfgaacGfaUfuuggasasc | GUUCCAAAUCGUUCCGAAUGUUU | 3364 |
| AD-796396.1 | A-1524811.1 | 1847 | asuscug(Ahd)GfaCfUfGfaauuugccgaL96 | A-1524812.1 | 1848 | VPusCfsggcAfaAfUfucagUfcUfcagauscsc | GGAUCUGAGACUGAAUUUGCCGA | 3365 |
| AD-796619.1 | A-1525249.1 | 1849 | gscsguu(Ghd)UfaGfUfUfccuaucuccaL96 | A-1525250.1 | 1850 | VPusGfsgagAfuAfGfgaacUfaCfaacgCSCSU | AGGCGUUGUAGUUCCUAUCUCCU | 3366 |
| AD-801647.1 | A-1535071.1 | 1851 | usasuau(Uhd)UfuAfCfAfacauccguuaL96 | A-1535072.1 | 1852 | VPusAfsacgGfaUfGfuuguAfaAfauauasusc | GAUAUAUUUUACAACAUCCGUUA | 3367 |

TABLE 4A-continued

Exemplary Human SCN9A siRNA Modified Single Strands and Duplex Sequences
Column 1 indicates duplex name and the number following the decimal point in a duplex name merely refers to a batch production number. Column 2 indicates the name of the sense sequence. Column 3 indicates the sequence ID for the sequence of column 4. Column 4 provides the modified sequence of a sense strand suitable for use in a duplex described herein. Column 5 indicates the antisense sequence name. Column 6 indicates the sequence ID for the sequence of column 7. Column 7 provides the sequence of a modified antisense strand suitable for use in a duplex described herein, e.g., a duplex comprising the sense sequence in the same row of the table. Column 8 indicates the position in the target mRNA (NM_001365536.1) that is complementary to the antisense strand of Column 7. Column 9 indicated the sequence ID for the sequence of column 8.

| Duplex Name | Sense sequence name | Seq ID NO: (sense) | Sense sequence (5'-3') | Antisense sequence name | Seq ID NO: (anti sense) | Antisense sequence (5'-3') | mRNA target sequence in NM_001365536.1 | Seq ID NO: (mRNA target) |
|---|---|---|---|---|---|---|---|---|
| AD-795304.1 | A-1522695.1 | 1853 | asusguc(Ghd)AfgUfAfCfacuuuuacuaL96 | A-1522696.1 | 1854 | VPusAfsguaAfaAfGfuguaCfuCfgacaususu | AAAUGUCGAGUACACUUUUACUG | 3368 |
| AD-802553.1 | A-1536879.1 | 1855 | usgsaua(Ghd)UfuAfCfCfuaguuugcaaL96 | A-1536880.1 | 1856 | VPusUfsgcaAfaCfUfagguAfaCfuaucasasa | UUUGAUAGUUACCUAGUUUGCAA | 3369 |
| AD-800819.1 | A-1533415.1 | 1857 | gsascuu(Ahd)CfcUfUfUfagaguauugaL96 | A-1533416.1 | 1858 | VPusCfsaauAfcUfCfuaaaGfgUfaagucsusu | AAGACUUACCUUUAGAGUAUUGU | 3370 |
| AD-801263.1 | A-1534303.1 | 1859 | csusaaa(Uhd)UfaUfGfGfaaguaaucuaL96 | A-1534304.1 | 1860 | VPusAfsgauUfaCfUfuccaUfaAfuuuagsgsa | UCCUAAAUUAUGGAAGUAAUCUU | 3371 |
| AD-798580.1 | A-1529029.1 | 1861 | asgsuca(Ahd)GfuUfCfCfaaaucguucaL96 | A-1529030.1 | 1862 | VPusGfsaacGfaUfUfuggaAfcUfugacususg | CAAGUCAAGUUCCAAAUCGUUCC | 3372 |
| AD-795912.1 | A-1523847.1 | 1863 | usgsauc(Uhd)UfcUfUfUfgucguagugaL96 | A-1523848.1 | 1864 | VPusCfsacuAfcGfAfcaaaGfaAfgaucasusg | CAUGAUCUUCUUUGUCGUAGUGA | 3373 |
| AD-802503.1 | A-1536779.1 | 1865 | gsusuug(Ahd)AfcAfCfAfaaucuuucgaL96 | A-1536780.1 | 1866 | VPusCfsgaaAfgAfUfuuguGfuUfcaaacscsu | AGGUUUGAACACAAAUCUUUCGG | 3374 |
| AD-798584.2 | A-1529037.1 | 1867 | asasguu(Chd)CfaAfAfUfcguuccgaaaL96 | A-1529038.1 | 1868 | VPusUfsucgGfaAfCfgauuUfgGfaacuusgsa | UCAAGUUCCAAAUCGUUCCGAAU | 3375 |
| AD-796827.1 | A-1525638.1 | 1869 | usgsuag(Ahd)UfcUfUfGfcaauuaccaaL96 | A-1257918.1 | 1870 | VPusUfsgguAfaUfUfgcaaGfaUfcuacasasa | UUUGUAGAUCUUGCAAUUACCAU | 3376 |

TABLE 4A-continued

Exemplary Human SCN9A siRNA Modified Single Strands and Duplex Sequences
Column 1 indicates duplex name and the number following the decimal point in a duplex name merely refers to a batch production number. Column 2 indicates the name of the sense sequence. Column 3 indicates the sequence ID for the sequence of column 4. Column 4 provides the modified sequence of a sense strand suitable for use in a duplex described herein. Column 5 indicates the antisense sequence name. Column 6 indicates the sequence ID for the sequence of column 7. Column 7 provides the sequence of a modified antisense strand suitable for use in a duplex described herein, e.g., a duplex comprising the sense sequence in the same row of the table. Column 8 indicates the position in the target mRNA (NM_001365536.1) that is complementary to the antisense strand of Column 7. Column 9 indicated the sequence ID for the sequence of column 8.

| Duplex Name | Sense sequence name | Seq ID NO: (sense) | Sense sequence (5'-3') | Antisense sequence name | Seq ID NO: (anti sense) | Antisense sequence (5'-3') | mRNA target sequence in NM_001365536.1 | Seq ID NO: (mRNA target) |
|---|---|---|---|---|---|---|---|---|
| AD-795910.1 | A-1523843.1 | 1871 | csasuga(Uhd)CfuUfCfUfuugucguagaL96 | A-1523844.1 | 1872 | VPusCfsuacGfaCfAfaagaAfgAfucaugsusa | UACAUGAUCUUCUUUGUCGUAGU | 3377 |
| AD-802552.1 | A-1536877.1 | 1873 | ususgau(Ahd)GfuUfAfCfcuaguuugcaL96 | A-1536878.1 | 1874 | VPusGfscaaAfcUfAfgguaAfcUfaucaasasa | UUUUGAUAGUUACCUAGUUUGCA | 3378 |
| AD-801304.1 | A-1534385.1 | 1875 | csasccu(Uhd)CfuCfCfUfuaaaauucuaL96 | A-1534386.1 | 1876 | VPusAfsgaaUfuUfUfaaggAfgAfaggugsasc | GUCACCUUCUCCUUAAAAUUCUA | 3379 |
| AD-800334.1 | A-1532445.1 | 1877 | csusgau(Uhd)UfcCfUfAfagaaaggugaL96 | A-1532446.1 | 1878 | VPusCfsaccUfuUfCfuuagGfaAfaucagsasg | CUCUGAUUUCCUAAGAAAGGUGG | 3380 |
| AD-802946.1 | A-1537662.1 | 1879 | usgsaga(Chd)UfgAfCfAfcauuguaaauaL96 | A-1537663.1 | 1880 | VPusAfsuuaCfaAfUfguguCfaGfucucasasg | CUUGAGACUGACACAUUGUAAUA | 3381 |
| AD-796087.1 | A-1524195.1 | 1881 | csusgaa(Uhd)AfuAfCfAfaguauuaggaL96 | A-1524196.1 | 1882 | VPusCfscuaAfuAfCfuuguAfuAfuucagscsc | GGCUGAAUAUACAAGUAUUAGGA | 3382 |
| AD-802625.2 | A-1537023.1 | 1883 | csasacc(Chd)AfaAfAfUfacuuagcauaL96 | A-1537024.1 | 1884 | VPusAfsugcUfaAfGfuauuUfuGfgguugsusg | CACAACCCAAAAUACUUAGCAUG | 3383 |
| AD-800966.1 | A-1533709.1 | 1885 | csusgau(Ahd)AfuAfGfUfcucuuaaacaL96 | A-1533710.1 | 1886 | VPusGfsuuuAfaGfAfgacuAfuUfaucagsusa | UACUGAUAAUAGUCUCUUAAACU | 3384 |
| AD-795920.1 | A-1523863.1 | 1887 | ususugu(Chd)GfuAfGfUfgauuuuccuaL96 | A-1523864.1 | 1888 | VPusAfsggaAfaAfUfcacuAfcGfacaaasgsa | UCUUUGUCGUAGUGAUUUUCCUG | 3385 |

TABLE 4A-continued

Exemplary Human SCN9A siRNA Modified Single Strands and Duplex Sequences
Column 1 indicates duplex name and the number following the decimal point in a duplex name merely refers to a batch production number. Column 2 indicates the name of the sense sequence. Column 3 indicates the sequence ID for the sequence of column 4. Column 4 provides the modified sequence of a sense strand suitable for use in a duplex described herein. Column 5 indicates the antisense sequence name. Column 6 indicates the sequence ID for the sequence of column 7. Column 7 provides the sequence of a modified antisense strand suitable for use in a duplex described herein, e.g., a duplex comprising the sense sequence in the same row of the table. Column 8 indicates the position in the target mRNA (NM_001365536.1) that is complementary to the antisense strand of Column 7. Column 9 indicated the sequence ID for the sequence of column 8.

| Duplex Name | Sense sequence name | Seq ID NO: (sense) | Sense sequence (5'-3') | Antisense sequence name | Seq ID NO: (anti sense) | Antisense sequence (5'-3') | mRNA target sequence in NM_001365536.1 | Seq ID NO: (mRNA target) |
|---|---|---|---|---|---|---|---|---|
| AD-796088.1 | A-1524197.1 | 1889 | usgsaau(Ahd)UfaCfAfAfguauuaggaaL96 | A-1524198.1 | 1890 | VPusUfsccuAfaUfAfcuugUfaUfauucasgsc | GCUGAAUAUACAAGUAUUAGGAG | 3386 |
| AD-799939.1 | A-1531657.1 | 1891 | asgsaug(Ghd)AfuUfCfUfcuucguucaaL96 | A-1531658.1 | 1892 | VPusUfsgaaCfgAfAfgagaAfuCfcaucuscsc | GGAGAUGGAUUCUCUUCGUUCAC | 3387 |
| AD-802853.2 | A-1537477.1 | 1893 | asasuau(Chd)AfuAfAfAfgcuguuuacaL96 | A-1537478.1 | 1894 | VPusGfsuaaAfcAfGfcuuuAfuGfauauuscsa | UGAAUAUCAUAAAGCUGUUUACA | 3388 |
| AD-801724.1 | A-1535225.1 | 1895 | uscsuuu(Ahd)UfaCfCfAfucuuagguuaL96 | A-1535226.1 | 1896 | VPusAfsaccUfaAfGfauggUfaUfaaagasasu | AUUCUUUAUACCAUCUUAGGUUC | 3389 |
| AD-797699.1 | A-1527312.1 | 1897 | gscsaaa(Ghd)GfuCfAfCfaauuuccucaL96 | A-1527313.1 | 1898 | VPusGfsaggAfaAfUfugugAfcCfuuugcsusc | GAGCAAAGGUCACAAUUUCCUCA | 3390 |
| AD-796304.1 | A-1524627.1 | 1899 | asgsuca(Chd)CfaCfUfCfagcauucguaL96 | A-1524628.1 | 1900 | VPusAfscgaAfuGfCfugagUfgGfugacusgsa | UCAGUCACCACUCAGCAUUCGUG | 3391 |
| AD-796920.1 | A-1525804.1 | 1901 | usgscua(Uhd)AfgGfAfAfauuuggucuaL96 | A-1525805.1 | 1902 | VPusAfsgacCfaAfAfuuucCfuAfuagcasasg | CUUGCUAUAGGAAAUUUGGUCUU | 3392 |
| AD-800110.1 | A-1531997.1 | 1903 | gsascag(Ahd)GfaUfGfAfugauuuacuaL96 | A-1531998.1 | 1904 | VPusAfsguaAfaUfCfaucaUfcUfcugucsusc | GAGACAGAGAUGAUGAUUUACUC | 3393 |
| AD-798579.1 | A-1529027.1 | 1905 | asasguc(Ahd)AfgUfUfCfcaaaucguuaL96 | A-1529028.1 | 1906 | VPusAfsacgAfuUfUfggaaCfuUfgacuusgsc | GCAAGUCAAGUUCCAAAUCGUUC | 3394 |

TABLE 4A-continued

Exemplary Human SCN9A siRNA Modified Single Strands and Duplex Sequences
Column 1 indicates duplex name and the number following the decimal point in a duplex name merely refers to a batch production number. Column 2 indicates the name of the sense sequence. Column 3 indicates the sequence ID for the sequence of column 4. Column 4 provides the modified sequence of a sense strand suitable for use in a duplex described herein. Column 5 indicates the antisense sequence name. Column 6 indicates the sequence ID for the sequence of column 7. Column 7 provides the sequence of a modified antisense strand suitable for use in a duplex described herein, e.g., a duplex comprising the sense sequence in the same row of the table. Column 8 indicates the position in the target mRNA (NM_001365536.1) that is complementary to the antisense strand of Column 7. Column 9 indicated the sequence ID for the sequence of column 8.

| Duplex Name | Sense sequence name | Seq ID NO: (sense) | Sense sequence (5'-3') | Antisense sequence name | Seq ID NO: (anti sense) | Antisense sequence (5'-3') | mRNA target sequence in NM_001365536.1 | Seq ID NO: (mRNA target) |
|---|---|---|---|---|---|---|---|---|
| AD-795841.1 | A-1523713.1 | 1907 | usasggc(Uhd)AfaUfGfAfcccaagauuaL96 | A-1523714.1 | 1908 | VPusAfsaucUfuGfGfgucaUfuAfgccuasasa | UUUAGGCUAAUGACCCAAGAUUA | 3395 |
| AD-802105.2 | A-1535987.1 | 1909 | asasgag(Chd)UfuAfUfUfaaguauaagaL96 | A-1535988.1 | 1910 | VPusCfsuuaUfaCfUfuaauAfaGfcucuUSUSC | GAAAGAGCUUAUUAAGUAUAAGC | 3396 |
| AD-799594.1 | A-1531002.1 | 1911 | usgsgaa(Uhd)AfuUfCfUfacuuuguuaaL96 | A-1531003.1 | 1912 | VPusUfsaacAfaAfGfuagaAfuAfuuccasasc | GUUGGAAUAUUCUACUUUGUUAG | 3397 |
| AD-800661.1 | A-1533099.1 | 1913 | asusgua(Chd)AfgAfGfGfuuauucuauaL96 | A-1533100.1 | 1914 | VPusAfsuagAfaUfAfaccuCfuGfuacaususg | CAAUGUACAGAGGUUAUUCUAUA | 3398 |
| AD-800400.1 | A-1532577.1 | 1915 | asuscgu(Ahd)AfgAfGfAfacucuguagaL96 | A-1532578.1 | 1916 | VPusCfsuacAfgAfGfuucuCfuUfacgaUSUSC | GAAUCGUAAGAGAACUCUGUAGG | 3399 |
| AD-799587.1 | A-1530988.1 | 1917 | csasucu(Ghd)UfuGfGfAfauauucuacaL96 | A-1530989.1 | 1918 | VPusGfsuagAfaUfAfuuccAfaCfagaugsgsg | CCCAUCUGUUGGAAUAUUCUACU | 3400 |
| AD-796936.1 | A-1525836.1 | 1919 | gsuscuu(Uhd)AfcUfGfGfaaucuuugcaL96 | A-1525837.1 | 1920 | VPusGfscaaAfgAfUfuccaGfuAfaagacscsa | UGGUCUUUACUGGAAUCUUUGCA | 3401 |
| AD-802014.1 | A-1535805.1 | 1921 | csasaca(Chd)AfaUfUfUfcuucuuagcaL96 | A-1535806.1 | 1922 | VPusGfscuaAfgAfAfgaaaUfuGfuguugsusu | AACAACACAAUUUCUUCUUAGCA | 3402 |
| AD-799942.1 | A-1531663.1 | 1923 | usgsgau(Uhd)CfuCfUfUfcguucacagaL96 | A-1531664.1 | 1924 | VPusCfsuguGfaAfCfgaagAfgAfauccasusc | GAUGGAUUCUCUUCGUUCACAGA | 3403 |

TABLE 4A-continued

Exemplary Human SCN9A siRNA Modified Single Strands and Duplex Sequences
Column 1 indicates duplex name and the number following the decimal point in a duplex name merely refers to a batch production number. Column 2 indicates the name of the sense sequence. Column 3 indicates the sequence ID for the sequence of column 4. Column 4 provides the modified sequence of a sense strand suitable for use in a duplex described herein. Column 5 indicates the antisense sequence name. Column 6 indicates the sequence ID for the sequence of column 7. Column 7 provides the sequence of a modified antisense strand suitable for use in a duplex described herein, e.g., a duplex comprising the sense sequence in the same row of the table. Column 8 indicates the position in the target mRNA (NM_001365536.1) that is complementary to the antisense strand of Column 7. Column 9 indicated the sequence ID for the sequence of column 8.

| Duplex Name | Sense sequence name | Seq ID NO: (sense) | Sense sequence (5'-3') | Antisense sequence name | Seq ID NO: (anti sense) | Antisense sequence (5'-3') | mRNA target sequence in NM_001365536.1 | Seq ID NO: (mRNA target) |
|---|---|---|---|---|---|---|---|---|
| AD-799221.1 | A-1530266.1 | 1925 | gsusaug(Uhd)UfuCfUfAfgcugauuugaL96 | A-1530267.1 | 1926 | VPusCfsaaaUfcAfGfcuagAfaAfcauacscsu | AGGUAUGUUUCUAGCUGAUUUGA | 3404 |
| AD-801062.1 | A-1533901.1 | 1927 | cscsuuc(Chd)UfgAfUfAfugcaguuagaL96 | A-1533902.1 | 1928 | VPusCfsuaaCfuGfCfauauCfaGfgaaggsasu | AUCCUUCCUGAUAUGCAGUUAGU | 3405 |
| AD-799937.1 | A-1531653.1 | 1929 | gsgsaga(Uhd)GfgAfUfUfcucuucguuaL96 | A-1531654.1 | 1930 | VPusAfsacgAfaGfAfgaauCfcAfucucCSCSC | GGGGAGAUGGAUUCUCUUCGUUC | 3406 |
| AD-800461.1 | A-1532699.1 | 1931 | gsusaga(Ahd)AfaCfUfUfuuacaucugaL96 | A-1532700.1 | 1932 | VPusCfsagaUfgUfAfaaagUfuUfucuacsasu | AUGUAGAAAACUUUUACAUCUGC | 3407 |
| AD-800058.1 | A-1531895.1 | 1933 | asgscgu(Ghd)CfuUfAfUfagacguuacaL96 | A-1531896.1 | 1934 | VPusGfsuaaCfgUfCfuauaAfgCfacgcusgsa | UCAGCGUGCUUAUAGACGUUACC | 3408 |
| AD-799225.1 | A-1530274.1 | 1935 | gsusuuc(Uhd)AfgCfUfGfauuugauugaL96 | A-1530275.1 | 1936 | VPusCfsaauCfaAfAfucagCfuAfgaaacsasu | AUGUUUCUAGCUGAUUUGAUUGA | 3409 |
| AD-800956.1 | A-1533689.1 | 1937 | gscscca(Ahd)AfaUfAfCfugauaauagaL96 | A-1533690.1 | 1938 | VPusCfsuauUfaUfCfaguaUfuUfugggcsasg | CUGCCCAAAAUACUGAUAAUAGU | 3410 |
| AD-801681.2 | A-1535139.1 | 1939 | ususugu(Chd)CfuAfAfUfcuacguauaaL96 | A-1535140.1 | 1940 | VPusUfsauaCfgUfAfgauuAfgGfacaaasusg | CAUUUGUCCUAAUCUACGUAUAA | 3411 |
| AD-802206.2 | A-1536189.1 | 1941 | usasauc(Ghd)CfuGfAfAfcuuauuacaaL96 | A-1536190.1 | 1942 | VPusUfsguaAfuAfAfguucAfgCfgauuasusa | UAUAAUCGCUGAACUUAUUACAC | 3412 |
| AD- | A- | 1943 | ususuga(Ahd)UfuCf | A- | 1944 | VPusAfsacgGfuAf | AAUUUGAAUUCAAUC | 3413 |

TABLE 4A-continued

Exemplary Human SCN9A siRNA Modified Single Strands and Duplex Sequences
Column 1 indicates duplex name and the number following the decimal point in a duplex name merely refers to a batch production number. Column 2 indicates the name of the sense sequence. Column 3 indicates the sequence ID for the sequence of column 4. Column 4 provides the modified sequence of a sense strand suitable for use in a duplex described herein. Column 5 indicates the antisense sequence name. Column 6 indicates the sequence ID for the sequence of column 7. Column 7 provides the sequence of a modified antisense strand suitable for use in a duplex described herein, e.g., a duplex comprising the sense sequence in the same row of the table. Column 8 indicates the position in the target mRNA (NM_001365536.1) that is complementary to the antisense strand of Column 7. Column 9 indicated the sequence ID for the sequence of column 8.

| Duplex Name | Sense sequence name | Seq ID NO: (sense) | Sense sequence (5'-3') | Antisense sequence name | Seq ID NO: (anti sense) | Antisense sequence (5'-3') | mRNA target sequence in NM_001365536.1 | Seq ID NO: (mRNA target) |
|---|---|---|---|---|---|---|---|---|
| 801883.2 | 1535543.1 | | AfAfucuaccguuaL96 | 1535544.1 | | GfauugAfaUfucaa asusu | UACCGUUA | |
| AD-800273.2 | A-1532323.1 | 1945 | csuscuu(Uhd)UfgAf GfGfaagucuaugaL96 | A-1532324.1 | 1946 | VPusCfsauaGfaCf UfuccuCfaAfaaga gsusu | AACUCUUUUGAGGAA GUCUAUGC | 3414 |
| AD-799231.2 | A-1530286.1 | 1947 | asgscug(Ahd)UfuUf GfAfuugaaacguaL96 | A-1530287.1 | 1948 | VPusAfscguUfuCf AfaucaAfaUfcagc usasg | CUAGCUGAUUUGAUU GAAACGUA | 3415 |
| AD-801725.1 | A-1535227.1 | 1949 | csusuua(Uhd)AfcCf AfUfcuuagguucaL96 | A-1535228.1 | 1950 | VPusGfsaacCfuAf AfgaugGfuAfuaaa gsasa | UUCUUUAUACCAUCUU AGGUUCA | 3416 |
| AD-794914.1 | A-1521918.1 | 1951 | ususgca(Ahd)GfcCf UfCfuuaugugagaL96 | A-1521919.1 | 1952 | VPusCfsucaCfaUf AfagagGfcUfugca ascsc | GGUUGCAAGCCUCUUA UGUGAGG | 3417 |
| AD-801132.1 | A-1534041.1 | 1953 | ususauu(Ghd)CfaUf CfAfcuuguauacaL96 | A-1534042.1 | 1954 | VPusGfsuauAfcAf AfgugaUfgCfaaua asasu | AUUUAUUGCAUCACU UGUAUACA | 3418 |
| AD-800492.2 | A-1532761.1 | 1955 | ususuca(Chd)AfgGf AfUfuguaauuagaL96 | A-1532762.1 | 1956 | VPusCfsuaaUfuAf CfaaucCfuGfugaa asasg | CUUUUCACAGGAUUG UAAUUAGU | 3419 |
| AD-800490.1 | A-1532757.1 | 1957 | csusuuu(Chd)AfcAf GfGfauuguaauuaL96 | A-1532758.1 | 1958 | VPusAfsauuAfcAf AfuccuGfuGfaaaa gsasu | AUCUUUUCACAGGAU UGUAAUUA | 3420 |
| AD-800414.2 | A-1532605.1 | 1959 | csusgua(Ghd)GfaAf UfUfauugauuauaL96 | A-1532606.1 | 1960 | VPusAfsuaaUfcAf AfuaauUfcCfuaca gsasg | CUCUGUAGGAAUUAU UGAUUAUA | 3421 |
| AD-801064.1 | A-1533905.1 | 1961 | ususccu(Ghd)AfuAf UfGfcaguuaguuaL96 | A-1533906.1 | 1962 | VPusAfsacuAfaCf UfgcauAfuCfagga asgsg | CCUUCCUGAUAUGCAG UUAGUUG | 3422 |

TABLE 4A-continued

Exemplary Human SCN9A siRNA Modified Single Strands and Duplex Sequences
Column 1 indicates duplex name and the number following the decimal point in a duplex name merely refers to a batch production number. Column 2 indicates the name of the sense sequence. Column 3 indicates the sequence ID for the sequence of column 4. Column 4 provides the modified sequence of a sense strand suitable for use in a duplex described herein. Column 5 indicates the antisense sequence name. Column 6 indicates the sequence ID for the sequence of column 7. Column 7 provides the sequence of a modified antisense strand suitable for use in a duplex described herein, e.g., a duplex comprising the sense sequence in the same row of the table. Column 8 indicates the position in the target mRNA (NM_001365536.1) that is complementary to the antisense strand of Column 7. Column 9 indicated the sequence ID for the sequence of column 8.

| Duplex Name | Sense sequence name | Seq ID NO: (sense) | Sense sequence (5'-3') | Antisense sequence name | Seq ID NO: (anti sense) | Antisense sequence (5'-3') | mRNA target sequence in NM_001365536.1 | Seq ID NO: (mRNA target) |
|---|---|---|---|---|---|---|---|---|
| AD-798577.1 | A-1529023.1 | 1963 | gscsaag(Uhd)CfaAfGfUfuccaaaucgaL96 | A-1529024.1 | 1964 | VPusCfsgauUfuGfGfaacuUfgAfcuugcsasg | CUGCAAGUCAAGUUCCAAAUCGU | 3423 |
| AD-799959.1 | A-1531697.1 | 1965 | gsgsaag(Ahd)AfaGfGfUfucaugucugaL96 | A-1531698.1 | 1966 | VPusCfsagaCfaUfGfaaccUfuUfcuuccsasu | AUGGAAGAAAGGUUCAUGUCUGC | 3424 |
| AD-801708.2 | A-1535193.1 | 1967 | asuscua(Ghd)GfgCfUfAfaagauucuuaL96 | A-1535194.1 | 1968 | VPusAfsagaAfuCfUfuuagCfcCfuagaususg | CAAUCUAGGGCUAAAGAUUCUUU | 3425 |
| AD-799230.2 | A-1530284.1 | 1969 | usasgcu(Ghd)AfuUfUfGfauugaaacgaL96 | A-1530285.1 | 1970 | VPusCfsguuUfcAfAfucaaAfuCfagcuasgsa | UCUAGCUGAUUUGAUUGAAACGU | 3426 |
| AD-801063.1 | A-1533903.1 | 1971 | csusucc(Uhd)GfaUfAfUfgcaguuaguaL96 | A-1533904.1 | 1972 | VPusAfscuaAfcUfGfcauaUfcAfggaagsgsa | UCCUUCCUGAUAUGCAGUUAGUU | 3427 |
| AD-800382.2 | A-1532541.1 | 1973 | ascsuga(Uhd)GfaUfUfCfuuuaagaauaL96 | A-1532542.1 | 1974 | VPusAfsuucUfuAfAfagaaUfcAfucagusgsc | GCACUGAUGAUUCUUUAAGAAUC | 3428 |
| AD-800069.1 | A-1531917.1 | 1975 | asgsacg(Uhd)UfaCfCfGfcuuaaggcaaL96 | A-1531918.1 | 1976 | VPusUfsgccUfuAfAfgcggUfaAfcgucusasu | AUAGACGUUACCGCUUAAGGCAA | 3429 |
| AD-796318.1 | A-1524655.1 | 1977 | uscsgug(Ghd)CfuCfCfUfuguuuucugaL96 | A-1524656.1 | 1978 | VPusCfsagaAfaAfCfaaggAfgCfcacgasasu | AUUCGUGGCUCCUUGUUUUCUGC | 3430 |
| AD-800849.2 | A-1533475.1 | 1979 | cscsuuu(Chd)UfuCfUfUfucauaucccaL96 | A-1533476.1 | 1980 | VPusGfsggaUfaUfGfaaagAfaGfaaaggscsu | AGCCUUUCUUCUUUCAUAUCCCU | 3431 |
| AD-800487.1 | A-1532751.1 | 1981 | csasucu(Uhd)UfuCfAfCfaggauuguaaL96 | A-1532752.1 | 1982 | VPusUfsacaAfuCfCfugugAfaAfagaugsasc | GUCAUCUUUUCACAGGAUUGUAA | 3432 |

TABLE 4A-continued

Exemplary Human SCN9A siRNA Modified Single Strands and Duplex Sequences
Column 1 indicates duplex name and the number following the decimal point in a duplex name merely refers to a batch production number. Column 2 indicates the name of the sense sequence. Column 3 indicates the sequence ID for the sequence of column 4. Column 4 provides the modified sequence of a sense strand suitable for use in a duplex described herein. Column 5 indicates the antisense sequence name. Column 6 indicates the sequence ID for the sequence of column 7. Column 7 provides the sequence of a modified antisense strand suitable for use in a duplex described herein, e.g., a duplex comprising the sense sequence in the same row of the table. Column 8 indicates the position in the target mRNA (NM_001365536.1) that is complementary to the antisense strand of Column 7. Column 9 indicated the sequence ID for the sequence of column 8.

| Duplex Name | Sense sequence name | Seq ID NO: (sense) | Sense sequence (5'-3') | Antisense sequence name | Seq ID NO: (anti sense) | Antisense sequence (5'-3') | mRNA target sequence in NM_001365536.1 | Seq ID NO: (mRNA target) |
|---|---|---|---|---|---|---|---|---|
| AD-801835.1 | A-1535447.1 | 1983 | csusguu(Ghd)GfaAfAfUfagguuuugaaL96 | A-1535448.1 | 1984 | VPusUfscaaAfaCfCfuauuUfcCfaacagsgsc | GCCUGUUGGAAAUAGGUUUUGAU | 3433 |
| AD-799936.1 | A-1531651.1 | 1985 | gsgsgag(Ahd)UfgGfAfUfucucuucguaL96 | A-1531652.1 | 1986 | VPusAfscgaAfgAfGfaaucCfaUfcuccscsa | UGGGGAGAUGGAUUCUCUUCGUU | 3434 |
| AD-801884.2 | A-1535545.1 | 1987 | ususgaa(Uhd)UfcAfAfUfcuaccguuaaL96 | A-1535546.1 | 1988 | VPusUfsaacGfgUfAfgauuGfaAfuucaasasu | AUUUGAAUUCAAUCUACCGUUAU | 3435 |
| AD-801747.2 | A-1535271.1 | 1989 | uscsauc(Uhd)UfaGfGfCfuauuugaacaL96 | A-1535272.1 | 1990 | VPusGfsuucAfaAfUfagccUfaAfgaugasasu | AUUCAUCUUAGGCUAUUUGAACC | 3436 |
| AD-800387.2 | A-1532551.1 | 1991 | usgsauu(Chd)UfuUfAfAfgaaucguaaaL96 | A-1532552.1 | 1992 | VPusUfsuacGfaUfUfcuuaAfaGfaaucasusc | GAUGAUUCUUUAAGAAUCGUAAG | 3437 |
| AD-800606.2 | A-1532989.1 | 1993 | gsusaau(Ghd)GfaCfAfUfuaguuaugaaL96 | A-1532990.1 | 1994 | VPusUfscauAfaCfUfaaugUfcCfauuacsusu | AAGUAAUGGACAUUAGUUAUGAA | 3438 |
| AD-802945.2 | A-1537660.1 | 1995 | ususgag(Ahd)CfuGfAfCfacauuguaaaL96 | A-1537661.1 | 1996 | VPusUfsuacAfaUfGfugucAfgUfcucaasgsu | ACUUGAGACUGACACAUUGUAAU | 3439 |
| AD-801886.2 | A-1535549.1 | 1997 | gsasauu(Chd)AfaUfCfUfaccguuauuuL96 | A-1535550.1 | 1998 | VPusAfsauaAfcGfGfuagaUfuGfaauucsasa | UUGAAUUCAAUCUACCGUUAUUU | 3440 |
| AD-800386.2 | A-1532549.1 | 1999 | asusgau(Uhd)CfuUfUfAfagaaucguaaL96 | A-1532550.1 | 2000 | VPusUfsacgAfuUfCfuuaaAfgAfaucauscsa | UGAUGAUUCUUUAAGAAUCGUAA | 3441 |

TABLE 4A-continued

Exemplary Human SCN9A siRNA Modified Single Strands and Duplex Sequences
Column 1 indicates duplex name and the number following the decimal point in a duplex name merely refers to a batch production number. Column 2 indicates the name of the sense sequence. Column 3 indicates the sequence ID for the sequence of column 4. Column 4 provides the modified sequence of a sense strand suitable for use in a duplex described herein. Column 5 indicates the antisense sequence name. Column 6 indicates the sequence ID for the sequence of column 7. Column 7 provides the sequence of a modified antisense strand suitable for use in a duplex described herein, e.g., a duplex comprising the sense sequence in the same row of the table. Column 8 indicates the position in the target mRNA (NM_001365536.1) that is complementary to the antisense strand of Column 7. Column 9 indicated the sequence ID for the sequence of column 8.

| Duplex Name | Sense sequence name | Seq ID NO: (sense) | Sense sequence (5'-3') | Antisense sequence name | Seq ID NO: (anti sense) | Antisense sequence (5'-3') | mRNA target sequence in NM_001365536.1 | Seq ID NO: (mRNA target) |
|---|---|---|---|---|---|---|---|---|
| AD-801832.1 | A-1535441.1 | 2001 | asgsccu(Ghd)UfuGfGfAfaauagguuuaL96 | A-1535442.1 | 2002 | VPusAfsaacCfuAfUfuuccAfaCfaggcususg | CAAGCCUGUUGGAAAUAGGUUUU | 3442 |
| AD-800060.1 | A-1531899.1 | 2003 | csgsugc(Uhd)UfaUfAfGfacguuaccgaL96 | A-1531900.1 | 2004 | VPusCfsgguAfaCfGfucuaUfaAfgcacgscsu | AGCGUGCUUAUAGACGUUACCGC | 3443 |
| AD-798332.1 | A-1528540.1 | 2005 | ususuag(Uhd)GfgCfAfAfacacucuugaL96 | A-1528541.1 | 2006 | VPusCfsaagAfgUfGfuuugCfcAfcuaaasgsu | ACUUUAGUGGCAAACACUCUUGG | 3444 |
| AD-802141.2 | A-1536059.1 | 2007 | ascscuc(Uhd)CfuUfUfCfcauguagauaL96 | A-1536060.1 | 2008 | VPusAfsucuAfcAfUfggaaAfgAfgaggUSCSU | AGACCUCUCUUUCCAUGUAGAUU | 3445 |
| AD-801251.1 | A-1534279.1 | 2009 | csasacu(Uhd)AfcUfUfUfccuaaauuaaL96 | A-1534280.1 | 2010 | VPusUfsaauUfuAfGfgaaaGfuAfaguugsgsu | ACCAACUUACUUUCCUAAAUUAU | 3446 |
| AD-797963.1 | A-1527829.1 | 2011 | gscsuga(Ahd)CfcUfAfUfgaauuccgaaL96 | A-1527830.1 | 2012 | VPusUfscggAfaUfUfcauaGfgUfucagCSCSU | AGGCUGAACCUAUGAAUUCCGAU | 3447 |
| AD-800297.2 | A-1532371.1 | 2013 | usasuca(Ahd)AfaUfAfUfucucgaaggaL96 | A-1532372.1 | 2014 | VPusCfscuuCfgAfGfaauaUfuUfugauasasa | UUUAUCAAAAUAUUCUCGAAGGC | 3448 |
| AD-801658.2 | A-1535093.1 | 2015 | ascsauc(Chd)GfuUfAfUfuacuuugagaL96 | A-1535094.1 | 2016 | VPusCfsucaAfaGfUfaauaAfcGfgaugususg | CAACAUCCGUUAUUACUUUGAGA | 3449 |
| AD-801676.2 | A-1535129.1 | 2017 | asgsaca(Uhd)UfuGfUfCfcuaaucuacaL96 | A-1535130.1 | 2018 | VPusGfsuagAfuUfAfggacAfaAfugucuscsa | UGAGACAUUUGUCCUAAUCUACG | 3450 |

TABLE 4A-continued

Exemplary Human SCN9A siRNA Modified Single Strands and Duplex Sequences
Column 1 indicates duplex name and the number following the decimal point in a duplex name merely refers to a batch production number. Column 2 indicates the name of the sense sequence. Column 3 indicates the sequence ID for the sequence of column 4. Column 4 provides the modified sequence of a sense strand suitable for use in a duplex described herein. Column 5 indicates the antisense sequence name. Column 6 indicates the sequence ID for the sequence of column 7. Column 7 provides the sequence of a modified antisense strand suitable for use in a duplex described herein, e.g., a duplex comprising the sense sequence in the same row of the table. Column 8 indicates the position in the target mRNA (NM_001365536.1) that is complementary to the antisense strand of Column 7. Column 9 indicated the sequence ID for the sequence of column 8.

| Duplex Name | Sense sequence name | Seq ID NO: (sense) | Sense sequence (5'-3') | Antisense sequence name | Seq ID NO: (anti sense) | Antisense sequence (5'-3') | mRNA target sequence in NM_001365536.1 | Seq ID NO: (mRNA target) |
|---|---|---|---|---|---|---|---|---|
| AD-799683.1 | A-1531160.1 | 2019 | usgscca(Chd)UfgAfAfGfaaaguacugaL96 | A-1531161.1 | 2020 | VPusCfsaguAfcUfUfucuuCfaGfuggcasasc | GUUGCCACUGAAGAAAGUACUGA | 3451 |
| AD-800486.1 | A-1532749.1 | 2021 | uscsauc(Uhd)UfuUfCfAfcaggauuguaL96 | A-1532750.1 | 2022 | VPusAfscaaUfcCfUfgugaAfaAfgaugascsa | UGUCAUCUUUUCACAGGAUUGUA | 3452 |
| AD-798672.1 | A-1529207.1 | 2023 | csgsgac(Uhd)UfgGfUfUfaccuaucucaL96 | A-1529208.1 | 2024 | VPusGfsagaUfaGfGfuaacCfaAfguccgsasc | GUCGGACUUGGUUACCUAUCUCU | 3453 |
| AD-802145.2 | A-1536067.1 | 2025 | csuscuu(Uhd)CfcAfUfGfuagauuacuaL96 | A-1536068.1 | 2026 | VPusAfsguaAfuCfUfacauGfgAfaagagsasg | CUCUCUUUCCAUGUAGAUUACUG | 3454 |
| AD-801540.2 | A-1534857.1 | 2027 | ascsaac(Uhd)UfuCfAfCfuaauuugcuaL96 | A-1534858.1 | 2028 | VPusAfsgcaAfaUfUfagugAfaAfguugUSUSU | AAACAACUUUCACUAAUUUGCUU | 3455 |
| AD-801654.2 | A-1535085.1 | 2029 | usascaa(Chd)AfuCfCfGfuuauuacuuaL96 | A-1535086.1 | 2030 | VPusAfsaguAfaUfAfacggAfuGfuugua sasa | UUUACAACAUCCGUUAUUACUUU | 3456 |
| AD-798667.1 | A-1529197.1 | 2031 | asasugu(Chd)GfgAfCfUfugguuaccuaL96 | A-1529198.1 | 2032 | VPusAfsgguAfaCfCfaaguCfcGfacauusasu | AUAAUGUCGGACUUGGUUACCUA | 3457 |
| AD-801655.2 | A-1535087.1 | 2033 | ascsaac(Ahd)UfcCfGfUfuauuacuuuaL96 | A-1535088.1 | 2034 | VPusAfsaagUfaAfUfaacgGfaUfguugusasa | UUACAACAUCCGUUAUUACUUUG | 3458 |
| AD-795826.1 | A-1523683.1 | 2035 | csusucu(Uhd)AfgCfCfUfuguuuaggcaL96 | A-1523684.1 | 2036 | VPusGfsccuAfaAfCfaaggCfuAfagaagsgsc | GCCUUCUUAGCCUUGUUUAGGCU | 3459 |

TABLE 4A-continued

Exemplary Human SCN9A siRNA Modified Single Strands and Duplex Sequences
Column 1 indicates duplex name and the number following the decimal point in a duplex name merely refers to a batch production number. Column 2 indicates the name of the sense sequence. Column 3 indicates the sequence ID for the sequence of column 4. Column 4 provides the modified sequence of a sense strand suitable for use in a duplex described herein. Column 5 indicates the antisense sequence name. Column 6 indicates the sequence ID for the sequence of column 7. Column 7 provides the sequence of a modified antisense strand suitable for use in a duplex described herein, e.g., a duplex comprising the sense sequence in the same row of the table. Column 8 indicates the position in the target mRNA (NM_001365536.1) that is complementary to the antisense strand of Column 7. Column 9 indicated the sequence ID for the sequence of column 8.

| Duplex Name | Sense sequence name | Seq ID NO: (sense) | Sense sequence (5'-3') | Antisense sequence name | Seq ID NO: (anti sense) | Antisense sequence (5'-3') | mRNA target sequence in NM_001365536.1 | Seq ID NO: (mRNA target) |
|---|---|---|---|---|---|---|---|---|
| AD-801490.2 | A-1534757.1 | 2037 | ascsaca(Ghd)GfuAfGfAfauguaguuuaL96 | A-1534758.1 | 2038 | VPusAfsaacUfaCfAfuucuAfcCfugugusasg | CUACACAGGUAGAAUGUAGUUUU | 3460 |
| AD-797964.1 | A-1527831.1 | 2039 | csusgaa(Chd)CfuAfUfGfaauuccgauaL96 | A-1527832.1 | 2040 | VPusAfsucgGfaAfUfucauAfgGfuucagscsc | GGCUGAACCUAUGAAUUCCGAUG | 3461 |
| AD-800389.2 | A-1532555.1 | 2041 | asusucu(Uhd)UfaAfGfAfaucguaagaaL96 | A-1532556.1 | 2042 | VPusUfscuuAfcGfAfuucuUfaAfagaauscsa | UGAUUCUUUAAGAAUCGUAAGAG | 3462 |
| AD-800388.2 | A-1532553.1 | 2043 | gsasuuc(Uhd)UfuAfAfGfaaucguaagaL96 | A-1532554.1 | 2044 | VPusCfsuuaCfgAfUfucuuAfaAfgaaucsasu | AUGAUUCUUUAAGAAUCGUAAGA | 3463 |
| AD-802070.2 | A-1535917.1 | 2045 | gsusuuc(Ahd)GfgAfAfUfgucuacuugaL96 | A-1535918.1 | 2046 | VPusCfsaagUfaGfAfcauuCfcUfgaaacsasa | UUGUUUCAGGAAUGUCUACUUGU | 3464 |
| AD-801601.2 | A-1534979.1 | 2047 | usasuag(Ahd)AfaCfAfAfagauuuaugaL96 | A-1534980.1 | 2048 | VPusCfsauaAfaUfCfuuugUfuUfcuauasgsg | CCUAUAGAAACAAAGAUUUAUGG | 3465 |
| AD-801653.1 | A-1535083.1 | 2049 | ususaca(Ahd)CfaUfCfCfguuauuacuaL96 | A-1535084.1 | 2050 | VPusAfsguaAfuAfAfcggaUfgUfuguaasasa | UUUUACAACAUCCGUUAUUACUU | 3466 |
| AD-802071.2 | A-1535919.1 | 2051 | ususuca(Ghd)GfaAfUfGfucuacuuguaL96 | A-1535920.1 | 2052 | VPusAfscaaGfuAfGfacauUfcCfugaaascsa | UGUUUCAGGAAUGUCUACUUGUG | 3467 |
| AD-800968.2 | A-1533713.1 | 2053 | gsasuaa(Uhd)AfgUfCfUfcuuaaacucaL96 | A-1533714.1 | 2054 | VPusGfsaguUfuAfAfgagaCfuAfuuaucsasg | CUGAUAAUAGUCUCUUAAACUCU | 3468 |

TABLE 4A-continued

Exemplary Human SCN9A siRNA Modified Single Strands and Duplex Sequences
Column 1 indicates duplex name and the number following the decimal point in a duplex name merely refers to a batch production number. Column 2 indicates the name of the sense sequence. Column 3 indicates the sequence ID for the sequence of column 4. Column 4 provides the modified sequence of a sense strand suitable for use in a duplex described herein. Column 5 indicates the antisense sequence name. Column 6 indicates the sequence ID for the sequence of column 7. Column 7 provides the sequence of a modified antisense strand suitable for use in a duplex described herein, e.g., a duplex comprising the sense sequence in the same row of the table. Column 8 indicates the position in the target mRNA (NM_001365536.1) that is complementary to the antisense strand of Column 7. Column 9 indicated the sequence ID for the sequence of column 8.

| Duplex Name | Sense sequence name | Seq ID NO: (sense) | Sense sequence (5'-3') | Antisense sequence name | Seq ID NO: (anti sense) | Antisense sequence (5'-3') | mRNA target sequence in NM_001365536.1 | Seq ID NO: (mRNA target) |
|---|---|---|---|---|---|---|---|---|
| AD-800667.2 | A-1533111.1 | 2055 | asgsagg(Uhd)UfaUfUfCfuauauuuugaL96 | A-1533112.1 | 2056 | VPusCfsaaaAfuAfUfagaaUfaAfccucusgsu | ACAGAGGUUAUUCUAUAUUUUGA | 3469 |
| AD-800008.2 | A-1531795.1 | 2057 | uscsaca(Ahd)CfcAfCfAfcuaaaacggaL96 | A-1531796.1 | 2058 | VPusCfscguUfuUfAfguguGfgUfugugasusg | CAUCACAACCACACUAAAACGGA | 3470 |
| AD-802016.2 | A-1535809.1 | 2059 | ascsaca(Ahd)UfuUfCfUfucuuagcauaL96 | A-1535810.1 | 2060 | VPusAfsugcUfaAfGfaagaAfaUfugugususg | CAACACAAUUUCUUCUUAGCAUU | 3471 |
| AD-799549.1 | A-1530912.1 | 2061 | uscsauc(Chd)UfgGfAfAfguucaguugaL96 | A-1530913.1 | 2062 | VPusCfsaacUfgAfAfcuucCfaGfgaugasasc | GUUCAUCCUGGAAGUUCAGUUGA | 3472 |
| AD-800706.2 | A-1533189.1 | 2063 | ususgca(Uhd)CfaGfAfAfccaauuuauaL96 | A-1533190.1 | 2064 | VPusAfsuaaAfuUfGfguucUfgAfugcaasusg | CAUUGCAUCAGAACCAAUUUAUA | 3473 |
| AD-801746.2 | A-1535269.1 | 2065 | ususcau(Chd)UfuAfGfGfcuauuugaaaL96 | A-1535270.1 | 2066 | VPusUfsucaAfaUfAfgccuAfaGfaugaasusg | CAUUCAUCUUAGGCUAUUUGAAC | 3474 |
| AD-801721.2 | A-1535219.1 | 2067 | gsasuuc(Uhd)UfuAfUfAfccaucuuagaL96 | A-1535220.1 | 2068 | VPusCfsuaaGfaUfGfguauAfaAfgaaucsusu | AAGAUUCUUUAUACCAUCUUAGG | 3475 |
| AD-802205.2 | A-1536187.1 | 2069 | asusaau(Chd)GfcUfGfAfacuuauuacaL96 | A-1536188.1 | 2070 | VPusGfsuaaUfaAfGfuucaGfcGfauuausasa | UUAUAAUCGCUGAACUUAUUACA | 3476 |
| AD-801680.2 | A-1535137.1 | 2071 | asusuug(Uhd)CfcUfAfAfucuacguauaL96 | A-1535138.1 | 2072 | VPusAfsuacGfuAfGfauuaGfgAfcaaausgsu | ACAUUUGUCCUAAUCUACGUAUA | 3477 |

TABLE 4A-continued

Exemplary Human SCN9A siRNA Modified Single Strands and Duplex Sequences
Column 1 indicates duplex name and the number following the decimal point in a duplex name merely refers to a batch production number. Column 2 indicates the name of the sense sequence. Column 3 indicates the sequence ID for the sequence of column 4. Column 4 provides the modified sequence of a sense strand suitable for use in a duplex described herein. Column 5 indicates the antisense sequence name. Column 6 indicates the sequence ID for the sequence of column 7. Column 7 provides the sequence of a modified antisense strand suitable for use in a duplex described herein, e.g., a duplex comprising the sense sequence in the same row of the table. Column 8 indicates the position in the target mRNA (NM_001365536.1) that is complementary to the antisense strand of Column 7. Column 9 indicated the sequence ID for the sequence of column 8.

| Duplex Name | Sense sequence name | Seq ID NO: (sense) | Sense sequence (5'-3') | Antisense sequence name | Seq ID NO: (anti sense) | Antisense sequence (5'-3') | mRNA target sequence in NM_001365536.1 | Seq ID NO: (mRNA target) |
|---|---|---|---|---|---|---|---|---|
| AD-800470.1 | A-1532717.1 | 2073 | ususuua(Chd)AfuCfUfGfccuugucauaL96 | A-1532718.1 | 2074 | VPusAfsugaCfaAfGfgcagAfuGfuaaaasgsu | ACUUUUACAUCUGCCUUGUCAUC | 3478 |
| AD-801678.2 | A-1535133.1 | 2075 | ascsauu(Uhd)GfuCfCfUfaaucuacguaL96 | A-1535134.1 | 2076 | VPusAfscguAfgAfUfuaggAfcAfaauguscsu | AGACAUUUGUCCUAAUCUACGUA | 3479 |
| AD-801022.2 | A-1533821.1 | 2077 | usgsuuu(Ahd)GfuCfAfUfccuuucgcuaL96 | A-1533822.1 | 2078 | VPusAfsgcgAfaAfGfgaugAfcUfaaacasasu | AUUGUUUAGUCAUCCUUUCGCUG | 3480 |
| AD-801309.2 | A-1534395.1 | 2079 | uscsucc(Uhd)UfaAfAfAfuucuaugauaL96 | A-1534396.1 | 2080 | VPusAfsucaUfaGfAfauuuUfaAfggagasasg | CUUCUCCUUAAAAUUCUAUGAUG | 3481 |
| AD-800496.2 | A-1532769.1 | 2081 | ascsagg(Ahd)UfuGfUfAfauuagucuuaL96 | A-1532770.1 | 2082 | VPusAfsagaCfuAfAfuuacAfaUfccugusgsa | UCACAGGAUUGUAAUUAGUCUUG | 3482 |
| AD-801738.2 | A-1535253.1 | 2083 | usasggu(Uhd)CfaUfUfCfaucuuaggcaL96 | A-1535254.1 | 2084 | VPusGfsccuAfaGfAfugaaUfgAfaccuasasg | CUUAGGUUCAUUCAUCUUAGGCU | 3483 |
| AD-801539.2 | A-1534855.1 | 2085 | asascaa(Chd)UfuUfCfAfcuaauuugcaL96 | A-1534856.1 | 2086 | VPusGfscaaAfuUfAfgugaAfaGfuugu ususu | AAAACAACUUUCACUAAUUUGCU | 3484 |
| AD-799010.2 | A-1529846.1 | 2087 | asasgcc(Uhd)UfuGfAfUfauuaguaucaL96 | A-1529847.1 | 2088 | VPusGfsauaCfuAfAfuaucAfaAfggcuusgsa | UCAAGCCUUUGAUAUUAGUAUCA | 3485 |
| AD-800850.2 | A-1533477.1 | 2089 | csusuuc(Uhd)UfcUfUfUfcauaucccuaL96 | A-1533478.1 | 2090 | VPusAfsgggAfuAfUfgaaaGfaAfgaaagsgsc | GCCUUUCUUCUUUCAUAUCCCUU | 3486 |

TABLE 4A-continued

Exemplary Human SCN9A siRNA Modified Single Strands and Duplex Sequences
Column 1 indicates duplex name and the number following the decimal point in a duplex name merely refers to a batch production number. Column 2 indicates the name of the sense sequence. Column 3 indicates the sequence ID for the sequence of column 4. Column 4 provides the modified sequence of a sense strand suitable for use in a duplex described herein. Column 5 indicates the antisense sequence name. Column 6 indicates the sequence ID for the sequence of column 7. Column 7 provides the sequence of a modified antisense strand suitable for use in a duplex described herein, e.g., a duplex comprising the sense sequence in the same row of the table. Column 8 indicates the position in the target mRNA (NM_001365536.1) that is complementary to the antisense strand of Column 7. Column 9 indicated the sequence ID for the sequence of column 8.

| Duplex Name | Sense sequence name | Seq ID NO: (sense) | Sense sequence (5'-3') | Antisense sequence name | Seq ID NO: (anti sense) | Antisense sequence (5'-3') | mRNA target sequence in NM_001365536.1 | Seq ID NO: (mRNA target) |
|---|---|---|---|---|---|---|---|---|
| AD-800494.2 | A-1532765.1 | 2091 | uscsaca(Ghd)GfaUfUfGfuaauuagucaL96 | A-1532766.1 | 2092 | VPusGfsacuAfaUfUfacaaUfcCfugugasasa | UUUCACAGGAUUGUAAUUAGUCU | 3487 |
| AD-798614.1 | A-1529091.1 | 2093 | ususgcc(Chd)UfuAfUfGfaauguuaguaL96 | A-1529092.1 | 2094 | VPusAfscuaAfcAfUfucauAfaGfggcaasasa | UUUUGCCCUUAUGAAUGUUAGUC | 3488 |
| AD-800709.2 | A-1533195.1 | 2095 | csasuca(Ghd)AfaCfCfAfauuuauaugaL96 | A-1533196.1 | 2096 | VPusCfsauaUfaAfAfuuggUfuCfugaugscsa | UGCAUCAGAACCAAUUUAUAUGU | 3489 |
| AD-801888.2 | A-1535553.1 | 2097 | asusuca(Ahd)UfcUfAfCfcguuauuucaL96 | A-1535554.1 | 2098 | VPusGfsaaaUfaAfCfgguaGfaUfugaaUSUSC | GAAUUCAAUCUACCGUUAUUUCA | 3490 |
| AD-801035.2 | A-1533847.1 | 2099 | ususucg(Chd)UfgUfAfAfgcaaaguugaL96 | A-1533848.1 | 2100 | VPusCfsaacUfuUfGfcuuaCfaGfcgaaasgsg | CCUUUCGCUGUAAGCAAAGUUGA | 3491 |
| AD-801020.2 | A-1533817.1 | 2101 | asusugu(Uhd)UfaGfUfCfauccuuucgaL96 | A-1533818.1 | 2102 | VPusCfsgaaAfgGfAfugacUfaAfacaausasc | GUAUUGUUUAGUCAUCCUUUCGC | 3492 |
| AD-801675.2 | A-1535127.1 | 2103 | gsasgac(Ahd)UfuUfGfUfccuaaucuaaL96 | A-1535128.1 | 2104 | VPusUfsagaUfuAfGfgacaAfaUfgucucsasa | UUGAGACAUUUGUCCUAAUCUAC | 3493 |
| AD-801228.2 | A-1534233.1 | 2105 | ususgcc(Ahd)AfcUfUfGfcucucuugcaL96 | A-1534234.1 | 2106 | VPusGfscaaGfaGfAfgcaaGfuUfggcaasgsa | UCUUGCCAACUUGCUCUCUUGCC | 3494 |
| AD-798984.1 | A-1529794.1 | 2107 | asusgua(Uhd)AfuUfUfGfaccuagugaaL96 | A-1529795.1 | 2108 | VPusUfscacUfaGfGfucaaAfuAfuacauscsc | GGAUGUAUAUUUGACCUAGUGAC | 3495 |

TABLE 4A-continued

Exemplary Human SCN9A siRNA Modified Single Strands and Duplex Sequences
Column 1 indicates duplex name and the number following the decimal point in a duplex name merely refers to a batch production number. Column 2 indicates the name of the sense sequence. Column 3 indicates the sequence ID for the sequence of column 4. Column 4 provides the modified sequence of a sense strand suitable for use in a duplex described herein. Column 5 indicates the antisense sequence name. Column 6 indicates the sequence ID for the sequence of column 7. Column 7 provides the sequence of a modified antisense strand suitable for use in a duplex described herein, e.g., a duplex comprising the sense sequence in the same row of the table. Column 8 indicates the position in the target mRNA (NM_001365536.1) that is complementary to the antisense strand of Column 7. Column 9 indicated the sequence ID for the sequence of column 8.

| Duplex Name | Sense sequence name | Seq ID NO: (sense) | Sense sequence (5'-3') | Antisense sequence name | Seq ID NO: (anti sense) | Antisense sequence (5'-3') | mRNA target sequence in NM_001365536.1 | Seq ID NO: (mRNA target) |
|---|---|---|---|---|---|---|---|---|
| AD-800495.2 | A-1532767.1 | 2109 | csascag(Ghd)AfuUfGfUfaauuagucuaL96 | A-1532768.1 | 2110 | VPusAfsgacUfaAfUfuacaAfuCfcugugsasa | UUCACAGGAUUGUAAUUAGUCUU | 3496 |
| AD-801957.2 | A-1535691.1 | 2111 | gsasugu(Uhd)UfgAfCfAfgguucguguaL96 | A-1535692.1 | 2112 | VPusAfscacGfaAfCfcuguCfaAfacaucsusu | AAGAUGUUUGACAGGUUCGUGUG | 3497 |
| AD-801399.2 | A-1534575.1 | 2113 | usasgcu(Ghd)UfaGfAfCfaucuaguuuaL96 | A-1534576.1 | 2114 | VPusAfsaacUfaGfAfugucUfaCfagcuasasu | AUUAGCUGUAGACAUCUAGUUUU | 3498 |
| AD-801489.2 | A-1534755.1 | 2115 | usascac(Ahd)GfgUfAfGfaauguaguuaL96 | A-1534756.1 | 2116 | VPusAfsacuAfcAfUfucuaCfcUfgugusgsc | GCUACACAGGUAGAAUGUAGUUU | 3499 |
| AD-800974.2 | A-1533725.1 | 2117 | asgsucu(Chd)UfuAfAfAfcucuuuuguaL96 | A-1533726.1 | 2118 | VPusAfscaaAfaGfAfguuuAfaGfagacusasu | AUAGUCUCUUAAACUCUUUUGUC | 3500 |
| AD-800007.2 | A-1531793.1 | 2119 | asuscac(Ahd)AfcCfAfCfacuaaaacgaL96 | A-1531794.1 | 2120 | VPusCfsguuUfuAfGfugugGfuUfgugausgsg | CCAUCACAACCACACUAAAACGG | 3501 |
| AD-801679.2 | A-1535135.1 | 2121 | csasuuu(Ghd)UfcCfUfAfaucuacguaaL96 | A-1535136.1 | 2122 | VPusUfsacgUfaGfAfuuagGfaCfaaaugsusc | GACAUUUGUCCUAAUCUACGUAU | 3502 |
| AD-798031.1 | A-1527964.1 | 2123 | csusgcc(Ahd)AfgUfUfAfacauagaguaL96 | A-1527965.1 | 2124 | VPusAfscucUfaUfGfuuaaCfuUfggcagscsa | UGCUGCCAAGUUAACAUAGAGUC | 3503 |
| AD-801397.2 | A-1534571.1 | 2125 | asusuag(Chd)UfgUfAfGfacaucuaguaL96 | A-1534572.1 | 2126 | VPusAfscuaGfaUfGfucuaCfaGfcuaausgsc | GCAUUAGCUGUAGACAUCUAGUU | 3504 |

TABLE 4A-continued

Exemplary Human SCN9A siRNA Modified Single Strands and Duplex Sequences
Column 1 indicates duplex name and the number following the decimal point in a duplex name merely refers to a batch production number. Column 2 indicates the name of the sense sequence. Column 3 indicates the sequence ID for the sequence of column 4. Column 4 provides the modified sequence of a sense strand suitable for use in a duplex described herein. Column 5 indicates the antisense sequence name. Column 6 indicates the sequence ID for the sequence of column 7. Column 7 provides the sequence of a modified antisense strand suitable for use in a duplex described herein, e.g., a duplex comprising the sense sequence in the same row of the table. Column 8 indicates the position in the target mRNA (NM_001365536.1) that is complementary to the antisense strand of Column 7. Column 9 indicated the sequence ID for the sequence of column 8.

| Duplex Name | Sense sequence name | Seq ID NO: (sense) | Sense sequence (5'-3') | Antisense sequence name | Seq ID NO: (anti sense) | Antisense sequence (5'-3') | mRNA target sequence in NM_001365536.1 | Seq ID NO: (mRNA target) |
|---|---|---|---|---|---|---|---|---|
| AD-800975.2 | A-1533727.1 | 2127 | gsuscuc(Uhd)UfaAfAfCfucuuuugucaL96 | A-1533728.1 | 2128 | VPusGfsacaAfaAfGfaguuUfaAfgagacsusa | UAGUCUCUUAAACUCUUUUGUCA | 3505 |
| AD-801677.2 | A-1535131.1 | 2129 | gsascau(Uhd)UfgUfCfCfuaaucuacgaL96 | A-1535132.1 | 2130 | VPusCfsguaGfaUfUfaggaCfaAfaugucsusc | GAGACAUUUGUCCUAAUCUACGU | 3506 |
| AD-801723.2 | A-1535223.1 | 2131 | ususcuu(Uhd)AfuAfCfCfaucuuagguaL96 | A-1535224.1 | 2132 | VPusAfsccuAfaGfAfugguAfuAfaagaasusc | GAUUCUUUAUACCAUCUUAGGUU | 3507 |
| AD-801491.2 | A-1534759.1 | 2133 | csascag(Ghd)UfaGfAfAfuguaguuuuaL96 | A-1534760.1 | 2134 | VPusAfsaaaCfuAfCfauucUfaCfcugugsusa | UACACAGGUAGAAUGUAGUUUUA | 3508 |
| AD-802153.2 | A-1536083.1 | 2135 | asusgua(Ghd)AfuUfAfCfuguuuguacaL96 | A-1536084.1 | 2136 | VPusGfsuacAfaAfCfaguaAfuCfuacausgsg | CCAUGUAGAUUACUGUUUGUACU | 3509 |
| AD-801140.2 | A-1534057.1 | 2137 | uscsacu(Uhd)GfuAfUfAfcaaucccguaL96 | A-1534058.1 | 2138 | VPusAfscggGfaUfUfguauAfcAfagugasusg | CAUCACUUGUAUACAAUCCCGUG | 3510 |
| AD-801745.2 | A-1535267.1 | 2139 | asusuca(Uhd)CfuUfAfGfgcuauuugaaL96 | A-1535268.1 | 2140 | VPusUfscaaAfuAfGfccuaAfgAfugaausgsa | UCAUUCAUCUUAGGCUAUUUGAA | 3511 |
| AD-801744.2 | A-1535265.1 | 2141 | csasuuc(Ahd)UfcUfUfAfggcuauuugaL96 | A-1535266.1 | 2142 | VPusCfsaaaUfaGfCfcuaaGfaUfgaaugsasa | UUCAUUCAUCUUAGGCUAUUUGA | 3512 |
| AD-802106.2 | A-1535989.1 | 2143 | asgsagc(Uhd)UfaUfUfAfaguauaagcaL96 | A-1535990.1 | 2144 | VPusGfscuuAfuAfCfuuaaUfaAfgcucususu | AAAGAGCUUAUUAAGUAUAAGCU | 3513 |

TABLE 4A-continued

Exemplary Human SCN9A siRNA Modified Single Strands and Duplex Sequences
Column 1 indicates duplex name and the number following the decimal point in a duplex name merely refers to a batch production number. Column 2 indicates the name of the sense sequence. Column 3 indicates the sequence ID for the sequence of column 4. Column 4 provides the modified sequence of a sense strand suitable for use in a duplex described herein. Column 5 indicates the antisense sequence name. Column 6 indicates the sequence ID for the sequence of column 7. Column 7 provides the sequence of a modified antisense strand suitable for use in a duplex described herein, e.g., a duplex comprising the sense sequence in the same row of the table. Column 8 indicates the position in the target mRNA (NM_001365536.1) that is complementary to the antisense strand of Column 7. Column 9 indicated the sequence ID for the sequence of column 8.

| Duplex Name | Sense sequence name | Seq ID NO: (sense) | Sense sequence (5'-3') | Antisense sequence name | Seq ID NO: (anti sense) | Antisense sequence (5'-3') | mRNA target sequence in NM_001365536.1 | Seq ID NO: (mRNA target) |
|---|---|---|---|---|---|---|---|---|
| AD-800384.2 | A-1532545.1 | 2145 | usgsaug(Ahd)UfuCfUfUfuaagaaucgaL96 | A-1532546.1 | 2146 | VPusCfsgauUfcUfUfaaagAfaUfcaucasgsu | ACUGAUGAUUCUUUAAGAAUCGU | 3514 |
| AD-796041.1 | A-1524103.1 | 2147 | csasaca(Ghd)AfuGfUfUfagaccgucuaL96 | A-1524104.1 | 2148 | VPusAfsgacGfgUfCfuaacAfuCfugugsasa | UUCAACAGAUGUUAGACCGUCUU | 3515 |

TABLE 4B

Exemplary Human SCN9A Unmodified Single Strands and Duplex Sequences. Column 1 indicates duplex name and the number following the decimal point in a duplex name merely refers to a batch production number. Column 2 indicates the sense sequence name. Column 3 indicates the sequence ID for the sequence of column 4. Column 4 provides the unmodified sequence of a sense strand suitable for use in a duplex described herein. Column 5 provides the position in the target mRNA (NM_001365536.1) of the sense strand of Column 4. Column 6 indicates the antisense sequence name. Column 7 indicates the sequence ID for the sequence of column 8. Column 8 provides the sequence of an antisense strand suitable for use in a duplex described herein, without specifying chemical modifications. Column 9 indicates the position in the target mRNA (NM_001365536.1) that is complementary to the antisense strand of Column 8.

| Duplex Name | Sense sequence name | Seq ID NO: (sense) | Sense sequence (5'-3') | mRNA target range in NM_001365536.1 | Anti sense sequence name | Seq ID NO: (anti sense) | antisense sequence (5'-3') | mRNA target range in NM_001365536.1 |
|---|---|---|---|---|---|---|---|---|
| AD-796825.1 | A-1525636.1 | 2149 | UUUGUAGAUCUUGCAAUUACA | 2531-2551 | A-1257916.1 | 2150 | UGUAAUUGCAAGAUCUACAAAAG | 2529-2551 |
| AD-795366.1 | A-1522818.1 | 2151 | UUCUGUGUAGGAGAAUUCACA | 824-844 | A-1522819.1 | 2152 | UGUGAAUUCUCCUACACAGAAGC | 822-844 |
| AD-797565.2 | A-1527044.1 | 2153 | AUGUGAAACAAACCUUACGUA | 3300-3320 | A-1527045.1 | 2154 | UACGUAAGGUUUGUUUCACAUAA | 3298-3320 |
| AD-795371.1 | A-1522828.1 | 2155 | UGUAGGAGAAUUCACUUUUCA | 829-849 | A-1522829.1 | 2156 | UGAAAAGUGAAUUCUCCUACACA | 827-849 |
| AD-797564.2 | A-1527042.1 | 2157 | UAUGUGAAACAAACCUUACGA | 3299-3319 | A-1527043.1 | 2158 | UCGUAAGGUUUGUUUCACAUAAU | 3297-3319 |
| AD-795634.2 | A-1523299.1 | 2159 | AGCAUAAAUGUUUUCGAAAUA | 1113-1133 | A-1523300.1 | 2160 | UAUUUCGAAAACAUUUAUGCUUC | 1111-1133 |
| AD-795913.1 | A-1523849.1 | 2161 | GAUCUUCUUUGUCGUAGUGAA | 1435-1455 | A-1523850.1 | 2162 | UUCACUACGACAAAGAAGAUCAU | 1433-1455 |
| AD-796618.1 | A-1525247.1 | 2163 | GGCGUUGUAGUUCCUAUCUCA | 2301-2321 | A-1525248.1 | 2164 | UGAGAUAGGAACUACAACGCCUU | 2299-2321 |
| AD-795914.1 | A-1523851.1 | 2165 | AUCUUCUUUGUCGUAGUGAUA | 1436-1456 | A-1523852.1 | 2166 | UAUCACUACGACAAAGAAGAUCA | 1434-1456 |
| AD-795739.1 | A-1523509.1 | 2167 | UGGUUUCAGCACAGAUUCAGA | 1243-1263 | A-1523510.1 | 2168 | UCUGAAUCUGUGCUGAAACCACA | 1241-1263 |
| AD-795305.1 | A-1522697.1 | 2169 | UGUCGAGUACACUUUUACUGA | 760-780 | A-1522698.1 | 2170 | UCAGUAAAAGUGUACUCGACAUU | 758-780 |
| AD-797636.2 | A-1527186.1 | 2171 | AAGCAGAAGAUCUGAAUACUA | 3375-3395 | A-1527187.1 | 2172 | UAGUAUUCAGAUCUUCUGCUUGU | 3373-3395 |
| AD-802471.2 | A-1536717.1 | 2173 | CAAGUGUUCCUACUGUCAUGA | 9104-9124 | A-1536718.1 | 2174 | UCAUGACAGUAGGAACACUUGAA | 9102-9124 |
| AD-796209.1 | A-1524439.1 | 2175 | AUGCUGAGAAAUUGUCGAAAA | 1785-1805 | A-1524440.1 | 2176 | UUUUCGACAAUUUCUCAGCAUCU | 1783-1805 |
| AD-799223.1 | A-1530270.1 | 2177 | AUGUUUCUAGCUGAUUUGAUA | 5075-5095 | A-1530271.1 | 2178 | UAUCAAAUCAGCUAGAAACAUAC | 5073-5095 |
| AD-799938.1 | A-1531655.1 | 2179 | GAGAUGGAUUCUCUUCGUUCA | 5861-5881 | A-1531656.1 | 2180 | UGAACGAAGAGAAUCCAUCUCCC | 5859-5881 |
| AD-797036.1 | A-1526036.1 | 2181 | UUGUGACUUUAAGUUUAGUGA | 2742-2762 | A-1526037.1 | 2182 | UCACUAAACUUAAAGUCACAAUA | 2740-2762 |
| AD-795911.1 | A-1523845.1 | 2183 | AUGAUCUUCUUUGUCGUAGUA | 1433-1453 | A-1523846.1 | 2184 | UACUACGACAAAGAAGAUCAUGU | 1431-1453 |
| AD-795132.1 | A-1522351.1 | 2185 | AAGGGAAAACAAUCUUCCGUA | 576-596 | A-1522352.1 | 2186 | UACGGAAGAUUGUUUUCCCUUUG | 574-596 |
| AD-796138.1 | A-1524297.1 | 2187 | CUUCUGAAACAUCCAAACUGA | 1683-1703 | A-1524298.1 | 2188 | UCAGUUUGGAUGUUUCAGAAGAA | 1681-1703 |

TABLE 4B-continued

Exemplary Human SCN9A Unmodified Single Strands and Duplex Sequences. Column 1 indicates duplex name and the number following the decimal point in a duplex name merely refers to a batch production number. Column 2 indicates the sense sequence name. Column 3 indicates the sequence ID for the sequence of column 4. Column 4 provides the unmodified sequence of a sense strand suitable for use in a duplex described herein. Column 5 provides the position in the target mRNA (NM_001365536.1) of the sense strand of Column 4. Column 6 indicates the antisense sequence name. Column 7 indicates the sequence ID for the sequence of column 8. Column 8 provides the sequence of an antisense strand suitable for use in a duplex described herein, without specifying chemical modifications. Column 9 indicates the position in the target mRNA (NM_001365536.1) that is complementary to the antisense strand of Column 8.

| Duplex Name | Sense sequence name | Seq ID NO: (sense) | Sense sequence (5'-3') | mRNA target range in NM_001365536.1 | Anti sense sequence name | Seq ID NO: (anti sense) | antisense sequence (5'-3') | mRNA target range in NM_001365536.1 |
|---|---|---|---|---|---|---|---|---|
| AD-796919.1 | A-1525802.1 | 2189 | UUGCUAUAGGAAAUUUGGUCA | 2625-2645 | A-1525803.1 | 2190 | UGACCAAAUUUCCUAUAGCAAGU | 2623-2645 |
| AD-797034.1 | A-1526032.1 | 2191 | UAUUGUGACUUUAAGUUUAGA | 2740-2760 | A-1526033.1 | 2192 | UCUAAACUUAAAGUCACAAUAAG | 2738-2760 |
| AD-795774.1 | A-1523579.1 | 2193 | UUGGCAGAAACCCUGAUUAUA | 1296-1316 | A-1523580.1 | 2194 | UAUAAUCAGGGUUUCUGCCAAUU | 1294-1316 |
| AD-795909.1 | A-1523841.1 | 2195 | ACAUGAUCUUCUUUGUCGUAA | 1431-1451 | A-1523842.1 | 2196 | UUACGACAAAGAAGAUCAUGUAG | 1429-1451 |
| AD-802123.1 | A-1536023.1 | 2197 | AGCUUGAAGUAAAAUUAGACA | 8687-8707 | A-1536024.1 | 2198 | UGUCUAAUUUUACUUCAAGCUUA | 8685-8707 |
| AD-798588.2 | A-1529045.1 | 2199 | UCCAAAUCGUUCCGAAUGUUA | 4390-4410 | A-1529046.1 | 2200 | UAACAUUCGGAACGAUUUGGAAC | 4388-4410 |
| AD-796396.1 | A-1524811.1 | 2201 | AUCUGAGACUGAAUUUGCCGA | 1993-2013 | A-1524812.1 | 2202 | UCGGCAAAUUCAGUCUCAGAUCC | 1991-2013 |
| AD-796619.1 | A-1525249.1 | 2203 | GCGUUGUAGUUCCUAUCUCCA | 2302-2322 | A-1525250.1 | 2204 | UGGAGAUAGGAACUACAACGCCU | 2300-2322 |
| AD-801647.1 | A-1535071.1 | 2205 | UAUAUUUUACAACAUCCGUUA | 8022-8042 | A-1535072.1 | 2206 | UAACGGAUGUUGUAAAAUAUAUC | 8020-8042 |
| AD-795304.1 | A-1522695.1 | 2207 | AUGUCGAGUACACUUUUACUA | 759-779 | A-1522696.1 | 2208 | UAGUAAAAGUGUACUCGACAUUU | 757-779 |
| AD-802553.1 | A-1536879.1 | 2209 | UGAUAGUUACCUAGUUUGCAA | 9226-9246 | A-1536880.1 | 2210 | UUGCAAACUAGGUAACUAUCAAA | 9224-9246 |
| AD-800819.1 | A-1533415.1 | 2211 | GACUUACCUUUAGAGUAUUGA | 6944-6964 | A-1533416.1 | 2212 | UCAAUACUCUAAAGGUAAGUCUU | 6942-6964 |
| AD-801263.1 | A-1534303.1 | 2213 | CUAAAUUAUGGAAGUAAUCUA | 7468-7488 | A-1534304.1 | 2214 | UAGAUUACUUCCAUAAUUUAGGA | 7466-7488 |
| AD-798580.1 | A-1529029.1 | 2215 | AGUCAAGUUCCAAAUCGUUCA | 4382-4402 | A-1529030.1 | 2216 | UGAACGAUUUGGAACUUGACUUG | 4380-4402 |
| AD-795912.1 | A-1523847.1 | 2217 | UGAUCUUCUUUGUCGUAGUGA | 1434-1454 | A-1523848.1 | 2218 | UCACUACGACAAAGAAGAUCAUG | 1432-1454 |
| AD-802503.1 | A-1536779.1 | 2219 | GUUUGAACACAAAUCUUUCGA | 9174-9194 | A-1536780.1 | 2220 | UCGAAAGAUUUGUGUUCAAACCU | 9172-9194 |
| AD-798584.2 | A-1529037.1 | 2221 | AAGUUCCAAAUCGUUCCGAAA | 4386-4406 | A-1529038.1 | 2222 | UUUCGGAACGAUUUGGAACUUGA | 4384-4406 |
| AD-796827.1 | A-1525638.1 | 2223 | UGUAGAUCUUGCAAUUACCAA | 2533-2553 | A-1257918.1 | 2224 | UUGGUAAUUGCAAGAUCUACAAA | 2531-2553 |
| AD-795910.1 | A-1523843.1 | 2225 | CAUGAUCUUCUUUGUCGUAGA | 1432-1452 | A-1523844.1 | 2226 | UCUACGACAAAGAAGAUCAUGUA | 1430-1452 |
| AD-802552.1 | A-1536877.1 | 2227 | UUGAUAGUUACCUAGUUUGCA | 9225-9245 | A-1536878.1 | 2228 | UGCAAACUAGGUAACUAUCAAAA | 9223-9245 |

TABLE 4B-continued

Exemplary Human SCN9A Unmodified Single Strands and Duplex Sequences. Column 1 indicates duplex name and the number following the decimal point in a duplex name merely refers to a batch production number. Column 2 indicates the sense sequence name. Column 3 indicates the sequence ID for the sequence of column 4. Column 4 provides the unmodified sequence of a sense strand suitable for use in a duplex described herein. Column 5 provides the position in the target mRNA (NM_001365536.1) of the sense strand of Column 4. Column 6 indicates the antisense sequence name. Column 7 indicates the sequence ID for the sequence of column 8. Column 8 provides the sequence of an antisense strand suitable for use in a duplex described herein, without specifying chemical modifications. Column 9 indicates the position in the target mRNA (NM_001365536.1) that is complementary to the antisense strand of Column 8.

| Duplex Name | Sense sequence name | Seq ID NO: (sense) | Sense sequence (5'-3') | mRNA target range in NM_001365536.1 | Anti sense sequence name | Seq ID NO: (anti sense) | antisense sequence (5'-3') | mRNA target range in NM_001365536.1 |
|---|---|---|---|---|---|---|---|---|
| AD-801304.1 | A-1534385.1 | 2229 | CACCUUCUCCUUAAAAUUCUA | 7527-7547 | A-1534386.1 | 2230 | UAGAAUUUUAAGGAGAAGGUGAC | 7525-7547 |
| AD-800334.1 | A-1532445.1 | 2231 | CUGAUUUCCUAAGAAAGGUGA | 6396-6416 | A-1532446.1 | 2232 | UCACCUUUCUUAGGAAAUCAGAG | 6394-6416 |
| AD-802946.1 | A-1537662.1 | 2233 | UGAGACUGACACAUUGUAAUA | 9700-9720 | A-1537663.1 | 2234 | UAUUACAAUGUGUCAGUCUCAAG | 9698-9720 |
| AD-796087.1 | A-1524195.1 | 2235 | CUGAAUAUACAAGUAUUAGGA | 1632-1652 | A-1524196.1 | 2236 | UCCUAAUACUUGUAUAUUCAGCC | 1630-1652 |
| AD-802625.2 | A-1537023.1 | 2237 | CAACCCAAAAUACUUAGCAUA | 9298-9318 | A-1537024.1 | 2238 | UAUGCUAAGUAUUUUGGGUUGUG | 9296-9318 |
| AD-800966.1 | A-1533709.1 | 2239 | CUGAUAAUAGUCUCUUAAACA | 7151-7171 | A-1533710.1 | 2240 | UGUUUAAGAGACUAUUAUCAGUA | 7149-7171 |
| AD-795920.1 | A-1523863.1 | 2241 | UUUGUCGUAGUGAUUUUCCUA | 1442-1462 | A-1523864.1 | 2242 | UAGGAAAAUCACUACGACAAAGA | 1440-1462 |
| AD-796088.1 | A-1524197.1 | 2243 | UGAAUAUACAAGUAUUAGGAA | 1633-1653 | A-1524198.1 | 2244 | UUCCUAAUACUUGUAUAUUCAGC | 1631-1653 |
| AD-799939.1 | A-1531657.1 | 2245 | AGAUGGAUUCUCUUCGUUCAA | 5862-5882 | A-1531658.1 | 2246 | UUGAACGAAGAGAAUCCAUCUCC | 5860-5882 |
| AD-802853.2 | A-1537477.1 | 2247 | AAUAUCAUAAAGCUGUUUACA | 9589-9609 | A-1537478.1 | 2248 | UGUAAACAGCUUUAUGAUAUUCA | 9587-9609 |
| AD-801724.1 | A-1535225.1 | 2249 | UCUUUAUACCAUCUUAGGUUA | 8099-8119 | A-1535226.1 | 2250 | UAACCUAAGAUGGUAUAAAGAAU | 8097-8119 |
| AD-797699.1 | A-1527312.1 | 2251 | GCAAAGGUCACAAUUUCCUCA | 3438-3458 | A-1527313.1 | 2252 | UGAGGAAAUUGUGACCUUUGCUC | 3436-3458 |
| AD-796304.1 | A-1524627.1 | 2253 | AGUCACCACUCAGCAUUCGUA | 1899-1919 | A-1524628.1 | 2254 | UACGAAUGCUGAGUGGUGACUGA | 1897-1919 |
| AD-796920.1 | A-1525804.1 | 2255 | UGCUAUAGGAAAUUUGGUCUA | 2626-2646 | A-1525805.1 | 2256 | UAGACCAAAUUUCCUAUAGCAAG | 2624-2646 |
| AD-800110.1 | A-1531997.1 | 2257 | GACAGAGAUGAUGAUUUACUA | 6059-6079 | A-1531998.1 | 2258 | UAGUAAAUCAUCAUCUCUGUCUC | 6057-6079 |
| AD-798579.1 | A-1529027.1 | 2259 | AAGUCAAGUUCCAAAUCGUUA | 4381-4401 | A-1529028.1 | 2260 | UAACGAUUUGGAACUUGACUUGC | 4379-4401 |
| AD-795841.1 | A-1523713.1 | 2261 | UAGGCUAAUGACCCAAGAUUA | 1363-1383 | A-1523714.1 | 2262 | UAAUCUUGGGUCAUUAGCCUAAA | 1361-1383 |
| AD-802105.2 | A-1535987.1 | 2263 | AAGAGCUUAUUAAGUAUAAGA | 8669-8689 | A-1535988.1 | 2264 | UCUUAUACUUAAUAAGCUCUUUC | 8667-8689 |
| AD-799594.1 | A-1531002.1 | 2265 | UGGAAUAUUCUACUUUGUUAA | 5503-5523 | A-1531003.1 | 2266 | UUAACAAAGUAGAAUAUUCCAAC | 5501-5523 |
| AD-800661.1 | A-1533099.1 | 2267 | AUGUACAGAGGUUAUUCUAUA | 6778-6798 | A-1533100.1 | 2268 | UAUAGAAUAACCUCUGUACAUUG | 6776-6798 |

TABLE 4B-continued

Exemplary Human SCN9A Unmodified Single Strands and Duplex Sequences. Column 1 indicates duplex name and the number following the decimal point in a duplex name merely refers to a batch production number. Column 2 indicates the sense sequence name. Column 3 indicates the sequence ID for the sequence of column 4. Column 4 provides the unmodified sequence of a sense strand suitable for use in a duplex described herein. Column 5 provides the position in the target mRNA (NM_001365536.1) of the sense strand of Column 4. Column 6 indicates the antisense sequence name. Column 7 indicates the sequence ID for the sequence of column 8. Column 8 provides the sequence of an antisense strand suitable for use in a duplex described herein, without specifying chemical modifications. Column 9 indicates the position in the target mRNA (NM_001365536.1) that is complementary to the antisense strand of Column 8.

| Duplex Name | Sense sequence name | Seq ID NO: (sense) | Sense sequence (5'-3') | mRNA target range in NM_001365536.1 | Anti sense sequence name | Seq ID NO: (anti sense) | antisense sequence (5'-3') | mRNA target range in NM_001365536.1 |
|---|---|---|---|---|---|---|---|---|
| AD-800400.1 | A-1532577.1 | 2269 | AUCGUAAGAGAACUCUGUAGA | 6462-6482 | A-1532578.1 | 2270 | UCUACAGAGUUCUCUUACGAUUC | 6460-6482 |
| AD-799587.1 | A-1530988.1 | 2271 | CAUCUGUUGGAAUAUUCUACA | 5496-5516 | A-1530989.1 | 2272 | UGUAGAAUAUUCCAACAGAUGGG | 5494-5516 |
| AD-796936.1 | A-1525836.1 | 2273 | GUCUUUACUGGAAUCUUUGCA | 2642-2662 | A-1525837.1 | 2274 | UGCAAAGAUUCCAGUAAAGACCA | 2640-2662 |
| AD-802014.1 | A-1535805.1 | 2275 | CAACACAAUUUCUUCUUAGCA | 8498-8518 | A-1535806.1 | 2276 | UGCUAAGAAGAAAUUGUGUUGUU | 8496-8518 |
| AD-799942.1 | A-1531663.1 | 2277 | UGGAUUCUCUUCGUUCACAGA | 5865-5885 | A-1531664.1 | 2278 | UCUGUGAACGAAGAGAAUCCAUC | 5863-5885 |
| AD-799221.1 | A-1530266.1 | 2279 | GUAUGUUUCUAGCUGAUUUGA | 5073-5093 | A-1530267.1 | 2280 | UCAAAUCAGCUAGAAACAUACCU | 5071-5093 |
| AD-801062.1 | A-1533901.1 | 2281 | CCUUCCUGAUAUGCAGUUAGA | 7247-7267 | A-1533902.1 | 2282 | UCUAACUGCAUAUCAGGAAGGAU | 7245-7267 |
| AD-799937.1 | A-1531653.1 | 2283 | GGAGAUGGAUUCUCUUCGUUA | 5860-5880 | A-1531654.1 | 2284 | UAACGAAGAGAAUCCAUCUCCCC | 5858-5880 |
| AD-800461.1 | A-1532699.1 | 2285 | GUAGAAAACUUUUACAUCUGA | 6547-6567 | A-1532700.1 | 2286 | UCAGAUGUAAAAGUUUUCUACAU | 6545-6567 |
| AD-800058.1 | A-1531895.1 | 2287 | AGCGUGCUUAUAGACGUUACA | 5988-6008 | A-1531896.1 | 2288 | UGUAACGUCUAUAAGCACGCUGA | 5986-6008 |
| AD-799225.1 | A-1530274.1 | 2289 | GUUUCUAGCUGAUUUGAUUGA | 5077-5097 | A-1530275.1 | 2290 | UCAAUCAAAUCAGCUAGAAACAU | 5075-5097 |
| AD-800956.1 | A-1533689.1 | 2291 | GCCCAAAAUACUGAUAAUAGA | 7141-7161 | A-1533690.1 | 2292 | UCUAUUAUCAGUAUUUUGGGCAG | 7139-7161 |
| AD-801681.2 | A-1535139.1 | 2293 | UUUGUCCUAAUCUACGUAUAA | 8056-8076 | A-1535140.1 | 2294 | UUAUACGUAGAUUAGGACAAAUG | 8054-8076 |
| AD-802206.2 | A-1536189.1 | 2295 | UAAUCGCUGAACUUAUUACAA | 8787-8807 | A-1536190.1 | 2296 | UUGUAAUAAGUUCAGCGAUUAUA | 8785-8807 |
| AD-801883.2 | A-1535543.1 | 2297 | UUUGAAUUCAAUCUACCGUUA | 8327-8347 | A-1535544.1 | 2298 | UAACGGUAGAUUGAAUUCAAAUU | 8325-8347 |
| AD-800273.2 | A-1532323.1 | 2299 | CUCUUUUGAGGAAGUCUAUGA | 6326-6346 | A-1532324.1 | 2300 | UCAUAGACUUCCUCAAAAGAGUU | 6324-6346 |
| AD-799231.2 | A-1530286.1 | 2301 | AGCUGAUUUGAUUGAAACGUA | 5083-5103 | A-1530287.1 | 2302 | UACGUUUCAAUCAAAUCAGCUAG | 5081-5103 |
| AD-801725.1 | A-1535227.1 | 2303 | CUUUAUACCAUCUUAGGUUCA | 8100-8120 | A-1535228.1 | 2304 | UGAACCUAAGAUGGUAUAAAGAA | 8098-8120 |
| AD-794914.1 | A-1521918.1 | 2305 | UUGCAAGCCUCUUAUGUGAGA | 243-263 | A-1521919.1 | 2306 | UCUCACAUAAGAGGCUUGCAACC | 241-263 |
| AD-801132.1 | A-1534041.1 | 2307 | UUAUUGCAUCACUUGUAUACA | 7317-7337 | A-1534042.1 | 2308 | UGUAUACAAGUGAUGCAAUAAAU | 7315-7337 |

TABLE 4B-continued

Exemplary Human SCN9A Unmodified Single Strands and Duplex Sequences. Column 1 indicates duplex name and the number following the decimal point in a duplex name merely refers to a batch production number. Column 2 indicates the sense sequence name. Column 3 indicates the sequence ID for the sequence of column 4. Column 4 provides the unmodified sequence of a sense strand suitable for use in a duplex described herein. Column 5 provides the position in the target mRNA (NM_001365536.1) of the sense strand of Column 4. Column 6 indicates the antisense sequence name. Column 7 indicates the sequence ID for the sequence of column 8. Column 8 provides the sequence of an antisense strand suitable for use in a duplex described herein, without specifying chemical modifications. Column 9 indicates the position in the target mRNA (NM_001365536.1) that is complementary to the antisense strand of Column 8.

| Duplex Name | Sense sequence name | Seq ID NO: (sense) | Sense sequence (5'-3') | mRNA target range in NM_001365536.1 | Anti sense sequence name | Seq ID NO: (anti sense) | antisense sequence (5'-3') | mRNA target range in NM_001365536.1 |
|---|---|---|---|---|---|---|---|---|
| AD-800492.2 | A-1532761.1 | 2309 | UUUCACAGGAUUGUAAUUAGA | 6578-6598 | A-1532762.1 | 2310 | UCUAAUUACAAUCCUGUGAAAAG | 6576-6598 |
| AD-800490.1 | A-1532757.1 | 2311 | CUUUUCACAGGAUUGUAAUUA | 6576-6596 | A-1532758.1 | 2312 | UAAUUACAAUCCUGUGAAAAGAU | 6574-6596 |
| AD-800414.2 | A-1532605.1 | 2313 | CUGUAGGAAUUAUUGAUUAUA | 6476-6496 | A-1532606.1 | 2314 | UAUAAUCAAUAAUUCCUACAGAG | 6474-6496 |
| AD-801064.1 | A-1533905.1 | 2315 | UUCCUGAUAUGCAGUUAGUUA | 7249-7269 | A-1533906.1 | 2316 | UAACUAACUGCAUAUCAGGAAGG | 7247-7269 |
| AD-798577.1 | A-1529023.1 | 2317 | GCAAGUCAAGUUCCAAAUCGA | 4379-4399 | A-1529024.1 | 2318 | UCGAUUUGGAACUUGACUUGCAG | 4377-4399 |
| AD-799959.1 | A-1531697.1 | 2319 | GGAAGAAAGGUUCAUGUCUGA | 5887-5907 | A-1531698.1 | 2320 | UCAGACAUGAACCUUUCUUCCAU | 5885-5907 |
| AD-801708.2 | A-1535193.1 | 2321 | AUCUAGGGCUAAAGAUUCUUA | 8083-8103 | A-1535194.1 | 2322 | UAAGAAUCUUUAGCCCUAGAUUG | 8081-8103 |
| AD-799230.2 | A-1530284.1 | 2323 | UAGCUGAUUUGAUUGAAACGA | 5082-5102 | A-1530285.1 | 2324 | UCGUUUCAAUCAAAUCAGCUAGA | 5080-5102 |
| AD-801063.1 | A-1533903.1 | 2325 | CUUCCUGAUAUGCAGUUAGUA | 7248-7268 | A-1533904.1 | 2326 | UACUAACUGCAUAUCAGGAAGGA | 7246-7268 |
| AD-800382.2 | A-1532541.1 | 2327 | ACUGAUGAUUCUUUAAGAAUA | 6444-6464 | A-1532542.1 | 2328 | UAUUCUUAAAGAAUCAUCAGUGC | 6442-6464 |
| AD-800069.1 | A-1531917.1 | 2329 | AGACGUUACCGCUUAAGGCAA | 5999-6019 | A-1531918.1 | 2330 | UUGCCUUAAGCGGUAACGUCUAU | 5997-6019 |
| AD-796318.1 | A-1524655.1 | 2331 | UCGUGGCUCCUUGUUUUCUGA | 1915-1935 | A-1524656.1 | 2332 | UCAGAAAACAAGGAGCCACGAAU | 1913-1935 |
| AD-800849.2 | A-1533475.1 | 2333 | CCUUUCUUCUUUCAUAUCCCA | 6974-6994 | A-1533476.1 | 2334 | UGGGAUAUGAAAGAAGAAAGGCU | 6972-6994 |
| AD-800487.1 | A-1532751.1 | 2335 | CAUCUUUUCACAGGAUUGUAA | 6573-6593 | A-1532752.1 | 2336 | UUACAAUCCUGUGAAAAGAUGAC | 6571-6593 |
| AD-801835.1 | A-1535447.1 | 2337 | CUGUUGGAAAUAGGUUUUGAA | 8222-8242 | A-1535448.1 | 2338 | UUCAAAACCUAUUUCCAACAGGC | 8220-8242 |
| AD-799936.1 | A-1531651.1 | 2339 | GGGAGAUGGAUUCUCUUCGUA | 5859-5879 | A-1531652.1 | 2340 | UACGAAGAGAAUCCAUCUCCCCA | 5857-5879 |
| AD-801884.2 | A-1535545.1 | 2341 | UUGAAUUCAAUCUACCGUUAA | 8328-8348 | A-1535546.1 | 2342 | UUAACGGUAGAUUGAAUUCAAAU | 8326-8348 |
| AD-801747.2 | A-1535271.1 | 2343 | UCAUCUUAGGCUAUUUGAACA | 8122-8142 | A-1535272.1 | 2344 | UGUUCAAAUAGCCUAAGAUGAAU | 8120-8142 |
| AD-800387.2 | A-1532551.1 | 2345 | UGAUUCUUUAAGAAUCGUAAA | 6449-6469 | A-1532552.1 | 2346 | UUUACGAUUCUUAAAGAAUCAUC | 6447-6469 |
| AD-800606.2 | A-1532989.1 | 2347 | GUAAUGGACAUUAGUUAUGAA | 6714-6734 | A-1532990.1 | 2348 | UUCAUAACUAAUGUCCAUUACUU | 6712-6734 |

TABLE 4B-continued

Exemplary Human SCN9A Unmodified Single Strands and Duplex Sequences. Column 1 indicates duplex name and the number following the decimal point in a duplex name merely refers to a batch production number. Column 2 indicates the sense sequence name. Column 3 indicates the sequence ID for the sequence of column 4. Column 4 provides the unmodified sequence of a sense strand suitable for use in a duplex described herein. Column 5 provides the position in the target mRNA (NM_001365536.1) of the sense strand of Column 4. Column 6 indicates the antisense sequence name. Column 7 indicates the sequence ID for the sequence of column 8. Column 8 provides the sequence of an antisense strand suitable for use in a duplex described herein, without specifying chemical modifications. Column 9 indicates the position in the target mRNA (NM_001365536.1) that is complementary to the antisense strand of Column 8.

| Duplex Name | Sense sequence name | Seq ID NO: (sense) | Sense sequence (5'-3') | mRNA target range in NM_001365536.1 | Anti sense sequence name | Seq ID NO: (anti sense) | antisense sequence (5'-3') | mRNA target range in NM_001365536.1 |
|---|---|---|---|---|---|---|---|---|
| AD-802945.2 | A-1537660.1 | 2349 | UUGAGACUGACACAUUGUAAA | 9699-9719 | A-1537661.1 | 2350 | UUUACAAUGUGUCAGUCUCAAGU | 9697-9719 |
| AD-801886.2 | A-1535549.1 | 2351 | GAAUUCAAUCUACCGUUAUUA | 8330-8350 | A-1535550.1 | 2352 | UAAUAACGGUAGAUUGAAUUCAA | 8328-8350 |
| AD-800386.2 | A-1532549.1 | 2353 | AUGAUUCUUUAAGAAUCGUAA | 6448-6468 | A-1532550.1 | 2354 | UUACGAUUCUUAAAGAAUCAUCA | 6446-6468 |
| AD-801832.1 | A-1535441.1 | 2355 | AGCCUGUUGGAAAUAGGUUUA | 8219-8239 | A-1535442.1 | 2356 | UAAACCUAUUUCCAACAGGCUUG | 8217-8239 |
| AD-800060.1 | A-1531899.1 | 2357 | CGUGCUUAUAGACGUUACCGA | 5990-6010 | A-1531900.1 | 2358 | UCGGUAACGUCUAUAAGCACGCU | 5988-6010 |
| AD-798332.1 | A-1528540.1 | 2359 | UUUAGUGGCAAACACUCUUGA | 4114-4134 | A-1528541.1 | 2360 | UCAAGAGUGUUUGCCACUAAAGU | 4112-4134 |
| AD-802141.2 | A-1536059.1 | 2361 | ACCUCUCUUUCCAUGUAGAUA | 8705-8725 | A-1536060.1 | 2362 | UAUCUACAUGGAAAGAGAGGUCU | 8703-8725 |
| AD-801251.1 | A-1534279.1 | 2363 | CAACUUACUUUCCUAAAUUAA | 7456-7476 | A-1534280.1 | 2364 | UUAAUUUAGGAAAGUAAGUUGGU | 7454-7476 |
| AD-797963.1 | A-1527829.1 | 2365 | GCUGAACCUAUGAAUUCCGAA | 3725-3745 | A-1527830.1 | 2366 | UUCGGAAUUCAUAGGUUCAGCCU | 3723-3745 |
| AD-800297.2 | A-1532371.1 | 2367 | UAUCAAAAUAUUCUCGAAGGA | 6359-6379 | A-1532372.1 | 2368 | UCCUUCGAGAAUAUUUUGAUAAA | 6357-6379 |
| AD-801658.2 | A-1535093.1 | 2369 | ACAUCCGUUAUUACUUUGAGA | 8033-8053 | A-1535094.1 | 2370 | UCUCAAAGUAAUAACGGAUGUUG | 8031-8053 |
| AD-801676.2 | A-1535129.1 | 2371 | AGACAUUUGUCCUAAUCUACA | 8051-8071 | A-1535130.1 | 2372 | UGUAGAUUAGGACAAAUGUCUCA | 8049-8071 |
| AD-799683.1 | A-1531160.1 | 2373 | UGCCACUGAAGAAAGUACUGA | 5593-5613 | A-1531161.1 | 2374 | UCAGUACUUUCUUCAGUGGCAAC | 5591-5613 |
| AD-800486.1 | A-1532749.1 | 2375 | UCAUCUUUUCACAGGAUUGUA | 6572-6592 | A-1532750.1 | 2376 | UACAAUCCUGUGAAAAGAUGACA | 6570-6592 |
| AD-798672.1 | A-1529207.1 | 2377 | CGGACUUGGUUACCUAUCUCA | 4474-4494 | A-1529208.1 | 2378 | UGAGAUAGGUAACCAAGUCCGAC | 4472-4494 |
| AD-802145.2 | A-1536067.1 | 2379 | CUCUUUCCAUGUAGAUUACUA | 8709-8729 | A-1536068.1 | 2380 | UAGUAAUCUACAUGGAAAGAGAG | 8707-8729 |
| AD-801540.2 | A-1534857.1 | 2381 | ACAACUUUCACUAAUUUGCUA | 7834-7854 | A-1534858.1 | 2382 | UAGCAAAUUAGUGAAAGUUGUUU | 7832-7854 |
| AD-801654.2 | A-1535085.1 | 2383 | UACAACAUCCGUUAUUACUUA | 8029-8049 | A-1535086.1 | 2384 | UAAGUAAUAACGGAUGUUGUAAA | 8027-8049 |
| AD-798667.1 | A-1529197.1 | 2385 | AAUGUCGGACUUGGUUACCUA | 4469-4489 | A-1529198.1 | 2386 | UAGGUAACCAAGUCCGACAUUAU | 4467-4489 |
| AD-801655.2 | A-1535087.1 | 2387 | ACAACAUCCGUUAUUACUUUA | 8030-8050 | A-1535088.1 | 2388 | UAAAGUAAUAACGGAUGUUGUAA | 8028-8050 |

TABLE 4B-continued

Exemplary Human SCN9A Unmodified Single Strands and Duplex Sequences. Column 1 indicates duplex name and the number following the decimal point in a duplex name merely refers to a batch production number. Column 2 indicates the sense sequence name. Column 3 indicates the sequence ID for the sequence of column 4. Column 4 provides the unmodified sequence of a sense strand suitable for use in a duplex described herein. Column 5 provides the position in the target mRNA (NM_001365536.1) of the sense strand of Column 4. Column 6 indicates the antisense sequence name. Column 7 indicates the sequence ID for the sequence of column 8. Column 8 provides the sequence of an antisense strand suitable for use in a duplex described herein, without specifying chemical modifications. Column 9 indicates the position in the target mRNA (NM_001365536.1) that is complementary to the antisense strand of Column 8.

| Duplex Name | Sense sequence name | Seq ID NO: (sense) | Sense sequence (5'-3') | mRNA target range in NM_001365536.1 | Anti sense sequence name | Seq ID NO: (anti sense) | antisense sequence (5'-3') | mRNA target range in NM_001365536.1 |
|---|---|---|---|---|---|---|---|---|
| AD-795826.1 | A-1523683.1 | 2389 | CUUCUUAGCCUUGUUUAGGCA | 1348-1368 | A-1523684.1 | 2390 | UGCCUAAACAAGGCUAAGAAGGC | 1346-1368 |
| AD-801490.2 | A-1534757.1 | 2391 | ACACAGGUAGAAUGUAGUUUA | 7770-7790 | A-1534758.1 | 2392 | UAAACUACAUUCUACCUGUGUAG | 7768-7790 |
| AD-797964.1 | A-1527831.1 | 2393 | CUGAACCUAUGAAUUCCGAUA | 3726-3746 | A-1527832.1 | 2394 | UAUCGGAAUUCAUAGGUUCAGCC | 3724-3746 |
| AD-800389.2 | A-1532555.1 | 2395 | AUUCUUUAAGAAUCGUAAGAA | 6451-6471 | A-1532556.1 | 2396 | UUCUUACGAUUCUUAAAGAAUCA | 6449-6471 |
| AD-800388.2 | A-1532553.1 | 2397 | GAUUCUUUAAGAAUCGUAAGA | 6450-6470 | A-1532554.1 | 2398 | UCUUACGAUUCUUAAAGAAUCAU | 6448-6470 |
| AD-802070.2 | A-1535917.1 | 2399 | GUUUCAGGAAUGUCUACUUGA | 8614-8634 | A-1535918.1 | 2400 | UCAAGUAGACAUUCCUGAAACAA | 8612-8634 |
| AD-801601.2 | A-1534979.1 | 2401 | UAUAGAAACAAAGAUUUAUGA | 7958-7978 | A-1534980.1 | 2402 | UCAUAAAUCUUUGUUUCUAUAGG | 7956-7978 |
| AD-801653.1 | A-1535083.1 | 2403 | UUACAACAUCCGUUAUUACUA | 8028-8048 | A-1535084.1 | 2404 | UAGUAAUAACGGAUGUUGUAAAA | 8026-8048 |
| AD-802071.2 | A-1535919.1 | 2405 | UUUCAGGAAUGUCUACUUGUA | 8615-8635 | A-1535920.1 | 2406 | UACAAGUAGACAUUCCUGAAACA | 8613-8635 |
| AD-800968.2 | A-1533713.1 | 2407 | GAUAAUAGUCUCUUAAACUCA | 7153-7173 | A-1533714.1 | 2408 | UGAGUUUAAGAGACUAUUAUCAG | 7151-7173 |
| AD-800667.2 | A-1533111.1 | 2409 | AGAGGUUAUUCUAUAUUUUGA | 6784-6804 | A-1533112.1 | 2410 | UCAAAAUAUAGAAUAACCUCUGU | 6782-6804 |
| AD-800008.2 | A-1531795.1 | 2411 | UCACAACCACACUAAAACGGA | 5937-5957 | A-1531796.1 | 2412 | UCCGUUUUAGUGUGGUUGUGAUG | 5935-5957 |
| AD-802016.2 | A-1535809.1 | 2413 | ACACAAUUUCUUCUUAGCAUA | 8500-8520 | A-1535810.1 | 2414 | UAUGCUAAGAAGAAAUUGUGUUG | 8498-8520 |
| AD-799549.1 | A-1530912.1 | 2415 | UCAUCCUGGAAGUUCAGUUGA | 5458-5478 | A-1530913.1 | 2416 | UCAACUGAACUUCCAGGAUGAAC | 5456-5478 |
| AD-800706.2 | A-1533189.1 | 2417 | UUGCAUCAGAACCAAUUUAUA | 6826-6846 | A-1533190.1 | 2418 | UAUAAAUUGGUUCUGAUGCAAUG | 6824-6846 |
| AD-801746.2 | A-1535269.1 | 2419 | UUCAUCUUAGGCUAUUUGAAA | 8121-8141 | A-1535270.1 | 2420 | UUUCAAAUAGCCUAAGAUGAAUG | 8119-8141 |
| AD-801721.2 | A-1535219.1 | 2421 | GAUUCUUUAUACCAUCUUAGA | 8096-8116 | A-1535220.1 | 2422 | UCUAAGAUGGUAUAAAGAAUCUU | 8094-8116 |
| AD-802205.2 | A-1536187.1 | 2423 | AUAAUCGCUGAACUUAUUACA | 8786-8806 | A-1536188.1 | 2424 | UGUAAUAAGUUCAGCGAUUAUAA | 8784-8806 |
| AD-801680.2 | A-1535137.1 | 2425 | AUUUGUCCUAAUCUACGUAUA | 8055-8075 | A-1535138.1 | 2426 | UAUACGUAGAUUAGGACAAAUGU | 8053-8075 |
| AD-800470.1 | A-1532717.1 | 2427 | UUUUACAUCUGCCUUGUCAUA | 6556-6576 | A-1532718.1 | 2428 | UAUGACAAGGCAGAUGUAAAAGU | 6554-6576 |

TABLE 4B-continued

Exemplary Human SCN9A Unmodified Single Strands and Duplex Sequences. Column 1 indicates duplex name and the number following the decimal point in a duplex name merely refers to a batch production number. Column 2 indicates the sense sequence name. Column 3 indicates the sequence ID for the sequence of column 4. Column 4 provides the unmodified sequence of a sense strand suitable for use in a duplex described herein. Column 5 provides the position in the target mRNA (NM_001365536.1) of the sense strand of Column 4. Column 6 indicates the antisense sequence name. Column 7 indicates the sequence ID for the sequence of column 8. Column 8 provides the sequence of an antisense strand suitable for use in a duplex described herein, without specifying chemical modifications. Column 9 indicates the position in the target mRNA (NM_001365536.1) that is complementary to the antisense strand of Column 8.

| Duplex Name | Sense sequence name | Seq ID NO: (sense) | Sense sequence (5'-3') | mRNA target range in NM_001365536.1 | Anti sense sequence name | Seq ID NO: (anti sense) | antisense sequence (5'-3') | mRNA target range in NM_001365536.1 |
|---|---|---|---|---|---|---|---|---|
| AD-801678.2 | A-1535133.1 | 2429 | ACAUUUGUCCUAAUCUACGUA | 8053-8073 | A-1535134.1 | 2430 | UACGUAGAUUAGGACAAAUGUCU | 8051-8073 |
| AD-801022.2 | A-1533821.1 | 2431 | UGUUUAGUCAUCCUUUCGCUA | 7207-7227 | A-1533822.1 | 2432 | UAGCGAAAGGAUGACUAAACAAU | 7205-7227 |
| AD-801309.2 | A-1534395.1 | 2433 | UCUCCUUAAAAUUCUAUGAUA | 7532-7552 | A-1534396.1 | 2434 | UAUCAUAGAAUUUUAAGGAGAAG | 7530-7552 |
| AD-800496.2 | A-1532769.1 | 2435 | ACAGGAUUGUAAUUAGUCUUA | 6582-6602 | A-1532770.1 | 2436 | UAAGACUAAUUACAAUCCUGUGA | 6580-6602 |
| AD-801738.2 | A-1535253.1 | 2437 | UAGGUUCAUUCAUCUUAGGCA | 8113-8133 | A-1535254.1 | 2438 | UGCCUAAGAUGAAUGAACCUAAG | 8111-8133 |
| AD-801539.2 | A-1534855.1 | 2439 | AACAACUUUCACUAAUUUGCA | 7833-7853 | A-1534856.1 | 2440 | UGCAAAUUAGUGAAAGUUGUUUU | 7831-7853 |
| AD-799010.2 | A-1529846.1 | 2441 | AAGCCUUUGAUAUUAGUAUCA | 4842-4862 | A-1529847.1 | 2442 | UGAUACUAAUAUCAAAGGCUUGA | 4840-4862 |
| AD-800850.2 | A-1533477.1 | 2443 | CUUUCUUCUUUCAUAUCCCUA | 6975-6995 | A-1533478.1 | 2444 | UAGGGAUAUGAAAGAAGAAAGGC | 6973-6995 |
| AD-800494.2 | A-1532765.1 | 2445 | UCACAGGAUUGUAAUUAGUCA | 6580-6600 | A-1532766.1 | 2446 | UGACUAAUUACAAUCCUGUGAAA | 6578-6600 |
| AD-798614.1 | A-1529091.1 | 2447 | UUGCCCUUAUGAAUGUUAGUA | 4410-4430 | A-1529092.1 | 2448 | UACUAACAUUCAUAAGGGCAAAA | 4408-4430 |
| AD-800709.2 | A-1533195.1 | 2449 | CAUCAGAACCAAUUUAUAUGA | 6829-6849 | A-1533196.1 | 2450 | UCAUAUAAAUUGGUUCUGAUGCA | 6827-6849 |
| AD-801888.2 | A-1535553.1 | 2451 | AUUCAAUCUACCGUUAUUUCA | 8332-8352 | A-1535554.1 | 2452 | UGAAAUAACGGUAGAUUGAAUUC | 8330-8352 |
| AD-801035.2 | A-1533847.1 | 2453 | UUUCGCUGUAAGCAAAGUUGA | 7220-7240 | A-1533848.1 | 2454 | UCAACUUUGCUUACAGCGAAAGG | 7218-7240 |
| AD-801020.2 | A-1533817.1 | 2455 | AUUGUUUAGUCAUCCUUUCGA | 7205-7225 | A-1533818.1 | 2456 | UCGAAAGGAUGACUAAACAAUAC | 7203-7225 |
| AD-801675.2 | A-1535127.1 | 2457 | GAGACAUUUGUCCUAAUCUAA | 8050-8070 | A-1535128.1 | 2458 | UUAGAUUAGGACAAAUGUCUCAA | 8048-8070 |
| AD-801228.2 | A-1534233.1 | 2459 | UUGCCAACUUGCUCUCUUGCA | 7433-7453 | A-1534234.1 | 2460 | UGCAAGAGAGCAAGUUGGCAAGA | 7431-7453 |
| AD-798984.1 | A-1529794.1 | 2461 | AUGUAUAUUUGACCUAGUGAA | 4816-4836 | A-1529795.1 | 2462 | UUCACUAGGUCAAAUAUACAUCC | 4814-4836 |
| AD-800495.2 | A-1532767.1 | 2463 | CACAGGAUUGUAAUUAGUCUA | 6581-6601 | A-1532768.1 | 2464 | UAGACUAAUUACAAUCCUGUGAA | 6579-6601 |
| AD-801957.2 | A-1535691.1 | 2465 | GAUGUUUGACAGGUUCGUGUA | 8404-8424 | A-1535692.1 | 2466 | UACACGAACCUGUCAAACAUCUU | 8402-8424 |
| AD-801399.2 | A-1534575.1 | 2467 | UAGCUGUAGACAUCUAGUUUA | 7625-7645 | A-1534576.1 | 2468 | UAAACUAGAUGUCUACAGCUAAU | 7623-7645 |

TABLE 4B-continued

Exemplary Human SCN9A Unmodified Single Strands and Duplex Sequences. Column 1 indicates duplex name and the number following the decimal point in a duplex name merely refers to a batch production number. Column 2 indicates the sense sequence name. Column 3 indicates the sequence ID for the sequence of column 4. Column 4 provides the unmodified sequence of a sense strand suitable for use in a duplex described herein. Column 5 provides the position in the target mRNA (NM_001365536.1) of the sense strand of Column 4. Column 6 indicates the antisense sequence name. Column 7 indicates the sequence ID for the sequence of column 8. Column 8 provides the sequence of an antisense strand suitable for use in a duplex described herein, without specifying chemical modifications. Column 9 indicates the position in the target mRNA (NM_001365536.1) that is complementary to the antisense strand of Column 8.

| Duplex Name | Sense sequence name | Seq ID NO: (sense) | Sense sequence (5'-3') | mRNA target range in NM_001365536.1 | Anti sense sequence name | Seq ID NO: (anti sense) | antisense sequence (5'-3') | mRNA target range in NM_001365536.1 |
|---|---|---|---|---|---|---|---|---|
| AD-801489.2 | A-1534755.1 | 2469 | UACACAGGUAGAAUGUAGUUA | 7769-7789 | A-1534756.1 | 2470 | UAACUACAUUCUACCUGUGUAGC | 7767-7789 |
| AD-800974.2 | A-1533725.1 | 2471 | AGUCUCUUAAACUCUUUUGUA | 7159-7179 | A-1533726.1 | 2472 | UACAAAAGAGUUUAAGAGACUAU | 7157-7179 |
| AD-800007.2 | A-1531793.1 | 2473 | AUCACAACCACACUAAAACGA | 5936-5956 | A-1531794.1 | 2474 | UCGUUUUAGUGUGGUUGUGAUGG | 5934-5956 |
| AD-801679.2 | A-1535135.1 | 2475 | CAUUUGUCCUAAUCUACGUAA | 8054-8074 | A-1535136.1 | 2476 | UUACGUAGAUUAGGACAAAUGUC | 8052-8074 |
| AD-798031.1 | A-1527964.1 | 2477 | CUGCCAAGUUAACAUAGAGUA | 3793-3813 | A-1527965.1 | 2478 | UACUCUAUGUUAACUUGGCAGCA | 3791-3813 |
| AD-801397.2 | A-1534571.1 | 2479 | AUUAGCUGUAGACAUCUAGUA | 7623-7643 | A-1534572.1 | 2480 | UACUAGAUGUCUACAGCUAAUGC | 7621-7643 |
| AD-800975.2 | A-1533727.1 | 2481 | GUCUCUUAAACUCUUUUGUCA | 7160-7180 | A-1533728.1 | 2482 | UGACAAAAGAGUUUAAGAGACUA | 7158-7180 |
| AD-801677.2 | A-1535131.1 | 2483 | GACAUUUGUCCUAAUCUACGA | 8052-8072 | A-1535132.1 | 2484 | UCGUAGAUUAGGACAAAUGUCUC | 8050-8072 |
| AD-801723.2 | A-1535223.1 | 2485 | UUCUUUAUACCAUCUUAGGUA | 8098-8118 | A-1535224.1 | 2486 | UACCUAAGAUGGUAUAAAGAAUC | 8096-8118 |
| AD-801491.2 | A-1534759.1 | 2487 | CACAGGUAGAAUGUAGUUUUA | 7771-7791 | A-1534760.1 | 2488 | UAAAACUACAUUCUACCUGUGUA | 7769-7791 |
| AD-802153.2 | A-1536083.1 | 2489 | AUGUAGAUUACUGUUUGUACA | 8717-8737 | A-1536084.1 | 2490 | UGUACAAACAGUAAUCUACAUGG | 8715-8737 |
| AD-801140.2 | A-1534057.1 | 2491 | UCACUUGUAUACAAUCCCGUA | 7325-7345 | A-1534058.1 | 2492 | UACGGGAUUGUAUACAAGUGAUG | 7323-7345 |
| AD-801745.2 | A-1535267.1 | 2493 | AUUCAUCUUAGGCUAUUUGAA | 8120-8140 | A-1535268.1 | 2494 | UUCAAAUAGCCUAAGAUGAAUGA | 8118-8140 |
| AD-801744.2 | A-1535265.1 | 2495 | CAUUCAUCUUAGGCUAUUUGA | 8119-8139 | A-1535266.1 | 2496 | UCAAAUAGCCUAAGAUGAAUGAA | 8117-8139 |
| AD-802106.2 | A-1535989.1 | 2497 | AGAGCUUAUUAAGUAUAAGCA | 8670-8690 | A-1535990.1 | 2498 | UGCUUAUACUUAAUAAGCUCUUU | 8668-8690 |
| AD-800384.2 | A-1532545.1 | 2499 | UGAUGAUUCUUUAAGAAUCGA | 6446-6466 | A-1532546.1 | 2500 | UCGAUUCUUAAAGAAUCAUCAGU | 6444-6466 |
| AD-796041.1 | A-1524103.1 | 2501 | CAACAGAUGUUAGACCGUCUA | 1568-1588 | A-1524104.1 | 2502 | UAGACGGUCUAACAUCUGUUGAA | 1566-1588 |

TABLE 5A

Exemplary Human SCN9A siRNA Modified Single Strands and Duplex Sequences
Column 1 indicates duplex name and the number following the decimal point in a duplex name merely refers to a batch production number. Column 2 indicates the name of the sense sequence. Column 3 indicates the sequence ID for the sequence of column 4. Column 4 provides the modified sequence of a sense strand suitable for use in a duplex described herein. Column 5 indicates the antisense sequence name. Column 6 indicates the sequence ID for the sequence of column 7. Column 7 provides the sequence of a modified antisense strand suitable for use in a duplex described herein, e.g., a duplex comprising the sense sequence in the same row of the table. Column 8 indicates the position in the target mRNA (NM 002977.3) that is complementary to the antisense strand of Column 7. Column 9 indicated the sequence ID for the sequence of column 8.

| Duplex Name | Sense sequence name | Seq ID NO: (sense) | Sense sequence (5'-3') | Antisense sequence name | Seq ID NO: (anti sense) | Antisense sequence (5'-3') | mRNA target sequence in NM_002977.3 | SEQ ID NO: (mRNA target) |
|---|---|---|---|---|---|---|---|---|
| AD-961208.1 | A-1812652.1 | 2503 | ususgug(Ahd)cudTudAaguuuagugaL96 | A-1812653.1 | 2593 | VPusdCsacdTadAacuudAadAgdTcacaasusa | UAUUGUGACUUUAAGUUUAGUGG | 3516 |
| AD-961207.1 | A-1812650.1 | 2504 | usasuug(Uhd)gadCudTuaaguuuagaL96 | A-1812651.1 | 2594 | VPusdCsuadAadCuuaadAgdTcdAcaauasasg | CUUAUUGUGACUUUAAGUUUAGU | 3517 |
| AD-1010662.1 | A-1851786.1 | 2505 | ususcug(Uhd)gudAgdGagaauucacaL96 | A-1875200.1 | 2595 | VPusdGsugdAadTucucdCudAcdAcagaasgsc | GCUUCUGUGUAGGAGAAUUCACU | 3518 |
| AD-961188.1 | A-1812612.1 | 2506 | csasuga(Uhd)cudTcdTuugucguagaL96 | A-1812613.1 | 2596 | VPusdCsuadCgdAcaaadGadAgdAucaugsusa | UACAUGAUCUUCUUUGUCGUAGU | 3519 |
| AD-1010663.1 | A-1851796.1 | 2507 | usgsuag(Ghd)agdAadTucacuuuucaL96 | A-1875201.1 | 2597 | VPusdGsaadAadGugaadTudCudCcuacascsa | UGUGUAGGAGAAUUCACUUUUCU | 3520 |
| AD-1010661.1 | A-1851664.1 | 2508 | usgsucg(Ahd)gudAcdAcuuuuacugaL96 | A-1875199.1 | 2598 | VPusdCsagdTadAaagudGudAcdTcgacasusu | AAUGUCGAGUACACUUUUACUGG | 3521 |
| AD-961189.1 | A-1812614.1 | 2509 | asusgau(Chd)uudCudTugucguaguaL96 | A-1812615.1 | 2599 | VPusdAscudAcdGacaadAgdAadGaucausgsu | ACAUGAUCUUCUUUGUCGUAGUG | 3522 |
| AD-1010671.1 | A-1853827.1 | 2510 | asuscug(Ahd)gadCudGaauuugccgaL96 | A-1875209.1 | 2600 | VPusdCsggdCadAauucdAgdTcdTcagauscsc | GGAUCUGAGACUGAAUUUGCCGA | 3523 |
| AD-961190.1 | A-1812616.1 | 2511 | usgsauc(Uhd)ucdTudTgucguagugaL96 | A-1812617.1 | 2601 | VPusdCsacdTadCgacadAadGadAgaucasusg | CAUGAUCUUCUUUGUCGUAGUGA | 3524 |
| AD-961179.1 | A-1812594.1 | 2512 | asasggg(Ahd)aadAcdAaucuuccguaL96 | A-1812595.1 | 2602 | VPusdAscgdGadAgauudGudTudTcccuususg | CAAAGGGAAAACAAUCUUCCGUU | 3525 |
| AD-961342.1 | A-1812920.1 | 2513 | asgscuu(Ghd)aadGudAaaauuagacaL96 | A-1812921.1 | 2603 | VPusdGsucdTadAuuuudAcdTudCaagcususa | UAAGCUUGAAGUAAAAUUAGACC | 3526 |

TABLE 5A-continued

Exemplary Human SCN9A siRNA Modified Single Strands and Duplex Sequences
Column 1 indicates duplex name and the number following the decimal point in a duplex name merely refers to a batch production number. Column 2 indicates the name of the sense sequence. Column 3 indicates the sequence ID for the sequence of column 4. Column 4 provides the modified sequence of a sense strand suitable for use in a duplex described herein. Column 5 indicates the antisense sequence name. Column 6 indicates the sequence ID for the sequence of column 7. Column 7 provides the sequence of a modified antisense strand suitable for use in a duplex described herein, e.g., a duplex comprising the sense sequence in the same row of the table. Column 8 indicates the position in the target mRNA (NM 002977.3) that is complementary to the antisense strand of Column 7. Column 9 indicated the sequence ID for the sequence of column 8.

| Duplex Name | Sense sequence name | Seq ID NO: (sense) | Sense sequence (5'-3') | Antisense sequence name | Seq ID NO: (anti sense) | Antisense sequence (5'-3') | mRNA target sequence in NM_002977.3 | SEQ ID NO: (mRNA target) |
|---|---|---|---|---|---|---|---|---|
| AD-1010673.1 | A-1854804.1 | 2514 | usgscua(Uhd)agdGadAauuuggucuaL96 | A-1875211.1 | 2604 | VPusdAsgadCcdAaauudTcdCudAuagcasasg | CUUGCUAUAGGAAAUUUGGUCUU | 3527 |
| AD-961192.1 | A-1812620.1 | 2515 | asuscuu(Chd)uudTgdTcguagugauaL96 | A-1812621.1 | 2605 | VPusdAsucdAcdTacgadCadAadGaagauscsa | UGAUCUUCUUUGUCGUAGUGAUU | 3528 |
| AD-961191.1 | A-1812618.1 | 2516 | gsasucu(Uhd)cudTudGucguagugaaL96 | A-1812619.1 | 2606 | VPusdTscadCudAcgacdAadAgdAagaucsasu | AUGAUCUUCUUUGUCGUAGUGAU | 3529 |
| AD-1010693.1 | A-1863139.1 | 2517 | ususauu(Ghd)cadTcdAcuuguauacaL96 | A-1875231.1 | 2607 | VPusdGsuadTadCaagudGadTgdCaauaasasu | AUUUAUUGCAUCACUUGUAUACA | 3530 |
| AD-961334.1 | A-1812904.1 | 2518 | csasaca(Chd)aadTudTcuucuuagcaL96 | A-1812905.1 | 2608 | VPusdGscudAadGaagadAadTudGuguugsusu | AACAACACAAUUUCUUCUUAGCA | 3531 |
| AD-1010697.1 | A-1864516.1 | 2519 | csusguu(Ghd)gadAadTagguuuugaaL96 | A-1875235.1 | 2609 | VPusdTscadAadAccuadTudTcdCaacagsgsc | GCCUGUUGGAAAUAGGUUUUGAU | 3532 |
| AD-961203.1 | A-1812642.1 | 2520 | ususugu(Ahd)gadTcdTugcaauuacaL96 | A-1812643.1 | 2610 | VPusdGsuadAudTgcaadGadTcdTacaaasasg | CUUUUGUAGAUCUUGCAAUUACC | 3533 |
| AD-1010664.1 | A-1852529.1 | 2521 | usgsguu(Uhd)cadGcdAcagauucagaL96 | A-1875202.1 | 2611 | VPusdCsugdAadTcugudGcdTgdAaaccascsa | UGUGGUUUCAGCACAGAUUCAGG | 3534 |
| AD-1010698.1 | A-1865925.1 | 2522 | ususgau(Ahd)gudTadCcuaguuugcaL96 | A-1875236.1 | 2612 | VPusdGscadAadCuaggdTadAcdTaucaasasa | UUUUGAUAGUUACCUAGUUUGCA | 3535 |
| AD-961187.1 | A-1812610.1 | 2523 | ascsaug(Ahd)ucdTudCuuugucguaaL96 | A-1812611.1 | 2613 | VPusdTsacdGadCaaagdAadGadTeaugusasg | CUACAUGAUCUUCUUUGUCGUAG | 3536 |
| AD-961350.1 | A-1812936.1 | 2524 | gsusuug(Ahd)acdAcdAaaucuuucgaL96 | A-1812937.1 | 2614 | VPusdCsgadAadGauuudGudGudTcaaacscsu | AGGUUUGAACACAAAUCUUUCGG | 3537 |
| AD-1010700.1 | A-1866708.1 | 2525 | usgsaga(Chd)ugdAcdAcauuguaauaL96 | A-1875238.1 | 2615 | VPusdAsuudAcdAaugudGudCadGucucasasg | CUUGAGACUGACACAUUGUAAUA | 3538 |

TABLE 5A-continued

Exemplary Human SCN9A siRNA Modified Single Strands and Duplex Sequences
Column 1 indicates duplex name and the number following the decimal point in a duplex name merely refers to a batch production number. Column 2 indicates the name of the sense sequence. Column 3 indicates the sequence ID for the sequence of column 4. Column 4 provides the modified sequence of a sense strand suitable for use in a duplex described herein. Column 5 indicates the antisense sequence name. Column 6 indicates the sequence ID for the sequence of column 7. Column 7 provides the sequence of a modified antisense strand suitable for use in a duplex described herein, e.g., a duplex comprising the sense sequence in the same row of the table. Column 8 indicates the position in the target mRNA (NM 002977.3) that is complementary to the antisense strand of Column 7. Column 9 indicated the sequence ID for the sequence of column 8.

| Duplex Name | Sense sequence name | Seq ID NO: (sense) | Sense sequence (5'-3') | Antisense sequence name | Seq ID NO: (anti sense) | Antisense sequence (5'-3') | mRNA target sequence in NM_002977.3 | SEQ ID NO: (mRNA target) |
|---|---|---|---|---|---|---|---|---|
| AD-961182.1 | A-1812600.1 | 2526 | asusguc(Ghd)agdTadCacuuuuacuaL96 | A-1812601.1 | 2616 | VPusdAsgudAadAagugdTadCudCgacaususu | AAAUGUCGAGUACACUUUUACUG | 3539 |
| AD-1010699.1 | A-1865927.1 | 2527 | usgsaua(Ghd)uudAcdCuaguuugcaaL96 | A-1875237.1 | 2617 | VPusdTsgcdAadAcuagdGudAadCuaucasasa | UUUGAUAGUUACCUAGUUUGCAA | 3540 |
| AD-1010696.1 | A-1864159.1 | 2528 | usasuau(Uhd)uudAcdAacauccguuaL96 | A-1875234.1 | 2618 | VPusdAsacdGgdAuguudGudAadAauauasusc | GAUAUAUUUUACAACAUCCGUUA | 3541 |
| AD-961321.1 | A-1812878.1 | 2529 | csusuua(Uhd)acdCadTcuuagguucaL96 | A-1812879.1 | 2619 | VPusdGsaadCcdTaagadTgdGudAuaaagsasa | UUCUUUAUACCAUCUUAGGUUCA | 3542 |
| AD-961279.1 | A-1812794.1 | 2530 | asusgua(Chd)agdAgdGuuauucuauaL96 | A-1812795.1 | 2620 | VPusdAsuadGadAuaacdCudCudGuacaususg | CAAUGUACAGAGGUUAUUCUAUA | 3543 |
| AD-1010672.1 | A-1854206.1 | 2531 | gscsguu(Ghd)uadGudTccuaucuccaL96 | A-1875210.1 | 2621 | VPusdGsgadGadTaggadAcdTadCaacgcscsu | AGGCGUUGUAGUUCCUAUCUCCU | 3544 |
| AD-961226.1 | A-1812688.1 | 2532 | asasguc(Ahd)agdTudCcaaaucguuaL96 | A-1812689.1 | 2622 | VPusdAsacdGadTuuggdAadCudTgacuusgsc | GCAAGUCAAGUUCCAAAUCGUUC | 3545 |
| AD-961225.1 | A-1812686.1 | 2533 | gscsaag(Uhd)cadAgdTuccaaaucgaL96 | A-1812687.1 | 2623 | VPusdCsgadTudTggaadCudTgdAcuugcsasg | CUGCAAGUCAAGUUCCAAAUCGU | 3546 |
| AD-1010665.1 | A-1852599.1 | 2534 | ususggc(Ahd)gadAadCccugauuauaL96 | A-1875203.1 | 2624 | VPusdAsuadAudCagggdTudTcdTgccaasusu | AAUUGGCAGAAACCCUGAUUAUG | 3547 |
| AD-961259.1 | A-1812754.1 | 2535 | csusgau(Uhd)ucdCudAagaaaggugaL96 | A-1812755.1 | 2625 | VPusdCsacdCudTucuudAgdGadAaucagsasg | CUCUGAUUUCCUAAGAAAGGUGG | 3548 |
| AD-961201.1 | A-1812638.1 | 2536 | uscsgug(Ghd)cudCcdTuguuuucugaL96 | A-1812639.1 | 2626 | VPusdCsagdAadAacaadGgdAgdCcacgasasu | AUUCGUGGCUCCUUGUUUUCUGC | 3549 |
| AD-1010674.1 | A-1854836.1 | 2537 | gsuscuu(Uhd)acdTgdGaaucuuugcaL96 | A-1875212.1 | 2627 | VPusdGscadAadGauucdCadGudAaagacscsa | UGGUCUUUACUGGAAUCUUUGCA | 3550 |

TABLE 5A-continued

Exemplary Human SCN9A siRNA Modified Single Strands and Duplex Sequences
Column 1 indicates duplex name and the number following the decimal point in a duplex name merely refers to a batch production number. Column 2 indicates the name of the sense sequence. Column 3 indicates the sequence ID for the sequence of column 4. Column 4 provides the modified sequence of a sense strand suitable for use in a duplex described herein. Column 5 indicates the antisense sequence name. Column 6 indicates the sequence ID for the sequence of column 7. Column 7 provides the sequence of a modified antisense strand suitable for use in a duplex described herein, e.g., a duplex comprising the sense sequence in the same row of the table. Column 8 indicates the position in the target mRNA (NM 002977.3) that is complementary to the antisense strand of Column 7. Column 9 indicated the sequence ID for the sequence of column 8.

| Duplex Name | Sense sequence name | Seq ID NO: (sense) | Sense sequence (5'-3') | Antisense sequence name | Seq ID NO: (anti sense) | Antisense sequence (5'-3') | mRNA target sequence in NM_002977.3 | SEQ ID NO: (mRNA target) |
|---|---|---|---|---|---|---|---|---|
| AD-1010670.1 | A-1853318.1 | 2538 | csusucu(Ghd)aadAcdAuccaaacugaL96 | A-1875208.1 | 2628 | VPusdCsagdTudTggaudGudTudCagaagsasa | UUCUUCUGAAACAUCCAAACUGA | 3551 |
| AD-961206.1 | A-1812648.1 | 2539 | ususgcu(Ahd)uadGgdAaauuuggucaL96 | A-1812649.1 | 2629 | VPusdGsacdCadAauuudCcdTadTagcaasgsu | ACUUGCUAUAGGAAAUUUGGUCU | 3552 |
| AD-961326.1 | A-1812888.1 | 2540 | asgsccu(Ghd)uudGgdAaauagguuuaL96 | A-1812889.1 | 2630 | VPusdAsaadCcdTauuudCcdAadCaggcususg | CAAGCCUGUUGGAAAUAGGUUUU | 3553 |
| AD-961239.1 | A-1812714.1 | 2541 | asusguu(Uhd)cudAgdCugauuugauaL96 | A-1812715.1 | 2631 | VPusdAsucdAadAucagdCudAgdAaacausasc | GUAUGUUUCUAGCUGAUUUGAUU | 3554 |
| AD-1010660.1 | A-1850886.1 | 2542 | ususgca(Ahd)gcdCudCuuaugugagaL96 | A-1875198.1 | 2632 | VPusdCsucdAcdAuaagdAgdGcdTugcaascsc | GGUUGCAAGCCUCUUAUGUGAGG | 3555 |
| AD-1010677.1 | A-1857611.1 | 2543 | ususuag(Uhd)ggdCadAacacucuugaL96 | A-1875215.1 | 2633 | VPusdCsaadGadGuguudTgdCcdAcuaaasgsu | ACUUUAGUGGCAAACACUCUUGG | 3556 |
| AD-1010690.1 | A-1862528.1 | 2544 | gsascuu(Ahd)ccdTudTagaguauugaL96 | A-1875228.1 | 2634 | VPusdCsaadTadCucuadAadGgdTaagucsusu | AAGACUUACCUUUAGAGUAUUGU | 3557 |
| AD-961202.1 | A-1812640.1 | 2545 | gsgscgu(Uhd)gudAgdTuccuaucucaL96 | A-1812641.1 | 2635 | VPusdGsagdAudAggaadCudAcdAacgccsusu | AAGGCGUUGUAGUUCCUAUCUCC | 3558 |
| AD-1010668.1 | A-1852884.1 | 2546 | ususugu(Chd)gudAgdTgauuuuccuaL96 | A-1875206.1 | 2636 | VPusdAsggdAadAaucadCudAcdGacaaasgsa | UCUUUGUCGUAGUGAUUUUCCUG | 3559 |
| AD-1010694.1 | A-1863376.1 | 2547 | csasacu(Uhd)acdTudTccuaaauuaaL96 | A-1875232.1 | 2637 | VPusdTsaadTudTaggadAadGudAaguugsgsu | ACCAACUUACUUUCCUAAAUUAU | 3560 |
| AD-1010679.1 | A-1859377.1 | 2548 | gsusaug(Uhd)uudCudAgcugauuugaL96 | A-1875217.1 | 2638 | VPusdCsaadAudCagcudAgdAadAcauacscsU | AGGUAUGUUUCUAGCUGAUUUGA | 3561 |
| AD-961257.1 | A-1812750.1 | 2549 | gsascag(Ahd)gadTgdAugauuuacuaL96 | A-1812751.1 | 2639 | VPusdAsgudAadAucaudCadTcdTcugucsusc | GAGACAGAGAUGAUGAUUUACUC | 3562 |
| AD- | A- | 2550 | gsasgau(Ghd)gadTu | A- | 2640 | VPusdGsaadCgdAaga | GGGAGAUGGAUUCUC | 3563 |

TABLE 5A-continued

Exemplary Human SCN9A siRNA Modified Single Strands and Duplex Sequences
Column 1 indicates duplex name and the number following the decimal point in a duplex name merely refers to a batch production number. Column 2 indicates the name of the sense sequence. Column 3 indicates the sequence ID for the sequence of column 4. Column 4 provides the modified sequence of a sense strand suitable for use in a duplex described herein. Column 5 indicates the antisense sequence name. Column 6 indicates the sequence ID for the sequence of column 7. Column 7 provides the sequence of a modified antisense strand suitable for use in a duplex described herein, e.g., a duplex comprising the sense sequence in the same row of the table. Column 8 indicates the position in the target mRNA (NM 002977.3) that is complementary to the antisense strand of Column 7. Column 9 indicated the sequence ID for the sequence of column 8.

| Duplex Name | Sense sequence name | Seq ID NO: (sense) | Sense sequence (5'-3') | Antisense sequence name | Seq ID NO: (anti sense) | Antisense sequence (5'-3') | mRNA target sequence in NM_002977.3 | SEQ ID NO: (mRNA target) |
|---|---|---|---|---|---|---|---|---|
| 961245.1 | 1812726.1 | | dCucuucguucaL96 | 1812727.1 | | gdAadTcdCaucucscsc | UUCGUUCA | |
| AD-1010692.1 | A-1863006.1 | 2551 | ususccu(Ghd)audAu dGcaguuaguuaL96 | A-1875230.1 | 2641 | VPusdAsacdTadAcugc dAudAudCaggaasgsg | CCUUCCUGAUAUGCAG UUAGUUG | 3564 |
| AD-1010695.1 | A-1863481.1 | 2552 | csasccu(Uhd)cudCc dTuaaaauucuaL96 | A-1875233.1 | 2642 | VPusdAsgadAudTuua adGgdAgdAaggugsas c | GUCACCUUCUCCUUAA AAUUCUA | 3565 |
| AD-961285.1 | A-1812806.1 | 2553 | csusgau(Ahd)audAg dTcucuuaaacaL96 | A-1812807.1 | 2643 | VPusdGsuudTadAgag adCudAudTaucagsus a | UACUGAUAAUAGUCUC UUAAACU | 3566 |
| AD-961300.1 | A-1812836.1 | 2554 | csusaaa(Uhd)uadTg dGaaguaaucuaL96 | A-1812837.1 | 2644 | VPusdAsgadTudAcuu cdCadTadAuuuagsgsa | UCCUAAAUUAUGGAAG UAAUCUU | 3567 |
| AD-961320.1 | A-1812876.1 | 2555 | uscsuuu(Ahd)uadCc dAucuuagguuaL96 | A-1812877.1 | 2645 | VPusdAsacdCudAaga udGgdTadTaaagasasu | AUUCUUUAUACCAUCU UAGGUUC | 3568 |
| AD-1010684.1 | A-1860794.1 | 2556 | gsgsaga(Uhd)ggdAu dTcucuucguuaL96 | A-1875222.1 | 2646 | VPusdAsacdGadAgag adAudCcdAucuccscsc | GGGGAGAUGGAUUCU CUUCGUUC | 3569 |
| AD-1010669.1 | A-1853216.1 | 2557 | usgsaau(Ahd)uadCa dAguauuaggaaL96 | A-1875207.1 | 2647 | VPusdTsccdTadAuacu dTgdTadTauucasgsc | GCUGAAUAUACAAGUA UUAGGAG | 3570 |
| AD-1010680.1 | A-1859383.1 | 2558 | gsusuuc(Uhd)agdCu dGauuugauugaL96 | A-1875218.1 | 2648 | VPusdCsaadTcdAaauc dAgdCudAgaaacsasu | AUGUUUCUAGCUGAU UUGAUUGA | 3571 |
| AD-961227.1 | A-1812690.1 | 2559 | asgsuca(Ahd)gudTc dCaaaucguucaL96 | A-1812691.1 | 2649 | VPusdGsaadCgdAuuu gdGadAcdTugacusus g | CAAGUCAAGUUCCAAA UCGUUCC | 3572 |
| AD-961243.1 | A-1812722.1 | 2560 | csasucu(Ghd)uudGg dAauauucuacaL96 | A-1812723.1 | 2650 | VPusdGsuadGadAuau udCcdAadCagaugsgsg | CCCAUCUGUUGGAAUA UUCUACU | 3573 |
| AD-961221.1 | A-1812678.1 | 2561 | csusgaa(Chd)cudAu dGaauuccgauaL96 | A-1812679.1 | 2651 | VPusdAsucdGgdAauu cdAudAgdGuucagscsc | GGCUGAACCUAUGAAU UCCGAUG | 3574 |
| AD- | A- | 2562 | csusuuu(Chd)acdAg | A- | 2652 | VPusdAsaudTadCaau | AUCUUUUCACAGGAU | 3575 |

TABLE 5A-continued

Exemplary Human SCN9A siRNA Modified Single Strands and Duplex Sequences
Column 1 indicates duplex name and the number following the decimal point in a duplex name merely refers to a batch production number. Column 2 indicates the name of the sense sequence. Column 3 indicates the sequence ID for the sequence of column 4. Column 4 provides the modified sequence of a sense strand suitable for use in a duplex described herein. Column 5 indicates the antisense sequence name. Column 6 indicates the sequence ID for the sequence of column 7. Column 7 provides the sequence of a modified antisense strand suitable for use in a duplex described herein, e.g., a duplex comprising the sense sequence in the same row of the table. Column 8 indicates the position in the target mRNA (NM 002977.3) that is complementary to the antisense strand of Column 7. Column 9 indicated the sequence ID for the sequence of column 8.

| Duplex Name | Sense sequence name | Seq ID NO: (sense) | Sense sequence (5'-3') | Antisense sequence name | Seq ID NO: (anti sense) | Antisense sequence (5'-3') | mRNA target sequence in NM_002977.3 | SEQ ID NO: (mRNA target) |
|---|---|---|---|---|---|---|---|---|
| 961271.1 | 1812778.1 | | dGauuguaauuaL96 | 1812779.1 | | cdCudGudGaaaagsas U | UGUAAUUA | |
| AD-961251.1 | A-1812738.1 | 2563 | asgscgu(Ghd)cudTa dTagacguuacaL96 | A-1812739.1 | 2653 | VPusdGsuadAcdGucu adTadAgdCacgcusgsa | UCAGCGUGCUUAUAGA CGUUACC | 3576 |
| AD-961296.1 | A-1812828.1 | 2564 | csusucc(Uhd)gadTa dTgcaguuaguaL96 | A-1812829.1 | 2654 | VPusdAscudAadCugc adTadTcdAggaagsgsa | UCCUUCCUGAUAUGCA GUUAGUU | 3577 |
| AD-961246.1 | A-1812728.1 | 2565 | gsgsaag(Ahd)aadGg dTucaugucugaL96 | A-1812729.1 | 2655 | VPusdCsagdAcdAuga adCcdTudTcuuccsasu | AUGGAAGAAAGGUUC AUGUCUGC | 3578 |
| AD-1010688.1 | A-1861826.1 | 2566 | gsusaga(Ahd)aadCu dTuuacaucugaL96 | A-1875226.1 | 2656 | VPusdCsagdAudGuaa adAgdTudTucuacsasu | AUGUAGAAAACUUUU ACAUCUGC | 3579 |
| AD-961269.1 | A-1812774.1 | 2567 | uscsauc(Uhd)uudTc dAcaggauuguaL96 | A-1812775.1 | 2657 | VPusdAscadAudCcug udGadAadAgaugascs a | UGUCAUCUUUUCACAG GAUUGUA | 3580 |
| AD-1010691.1 | A-1862804.1 | 2568 | gscscca(Ahd)aadTa dCugauaaaugaL96 | A-1875229.1 | 2658 | VPusdCsuadTudAuca gdTadTudTugggcsasg | CUGCCCAAAAUACUGA UAAUAGU | 3581 |
| AD-1010689.1 | A-1861844.1 | 2569 | usususa(Chd)audCu dGccuugucauaL96 | A-1875227.1 | 2659 | VPusdAsugdAcdAagg cdAgdAudGuaaaasgs u | ACUUUUACAUCUGCCU UGUCAUC | 3582 |
| AD-1010667.1 | A-1852732.1 | 2570 | usasggc(Uhd)aadTg dAcccaagauuaL96 | A-1875205.1 | 2660 | VPusdAsaudCudTggg udCadTudAgccuasasa | UUUAGGCUAAUGACCC AAGAUUA | 3583 |
| AD-961252.1 | A-1812740.1 | 2571 | csgsugc(Uhd)uadTa dGacguuaccgaL96 | A-1812741.1 | 2661 | VPusdCsggdTadAcguc dTadTadAgcacgscsu | AGCGUGCUUAUAGACG UUACCGC | 3584 |
| AD-1010666.1 | A-1852704.1 | 2572 | csusucu(Uhd)agdCc dTuguuuaggcaL96 | A-1875204.1 | 2662 | VPusdGsccdTadAacaa dGgdCudAagaagsgsc | GCCUUCUUAGCCUUGU UUAGGCU | 3585 |
| AD-1010682.1 | A-1860117.1 | 2573 | usgsgaa(Uhd)audTc dTacuuuguuaaL96 | A-1875220.1 | 2663 | VPusdTsaadCadAagu adGadAudAuuccasas c | GUUGGAAUAUUCUAC UUUGUUAG | 3586 |

TABLE 5A-continued

Exemplary Human SCN9A siRNA Modified Single Strands and Duplex Sequences
Column 1 indicates duplex name and the number following the decimal point in a duplex name merely refers to a batch production number. Column 2 indicates the name of the sense sequence. Column 3 indicates the sequence ID for the sequence of column 4. Column 4 provides the modified sequence of a sense strand suitable for use in a duplex described herein. Column 5 indicates the antisense sequence name. Column 6 indicates the sequence ID for the sequence of column 7. Column 7 provides the sequence of a modified antisense strand suitable for use in a duplex described herein, e.g., a duplex comprising the sense sequence in the same row of the table. Column 8 indicates the position in the target mRNA (NM 002977.3) that is complementary to the antisense strand of Column 7. Column 9 indicated the sequence ID for the sequence of column 8.

| Duplex Name | Sense sequence name | Seq ID NO: (sense) | Sense sequence (5'-3') | Antisense sequence name | Seq ID NO: (anti sense) | Antisense sequence (5'-3') | mRNA target sequence in NM_002977.3 | SEQ ID NO: (mRNA target) |
|---|---|---|---|---|---|---|---|---|
| AD-961196.1 | A-1812628.1 | 2574 | csusgaa(Uhd)audAcdAaguauuaggaL96 | A-1812629.1 | 2664 | VPusdCscudAadTacuudGudAudAuucagscsc | GGCUGAAUAUACAAGUAUUAGGA | 3587 |
| AD-1010676.1 | A-1857011.1 | 2575 | csusgcc(Ahd)agdTudAacauagaguaL96 | A-1875214.1 | 2665 | VPusdAscudCudAuguudAadCudTggcagscsa | UGCUGCCAAGUUAACAUAGAGUC | 3588 |
| AD-1010686.1 | A-1860802.1 | 2576 | usgsgau(Uhd)cudCudTcguucacagaL96 | A-1875224.1 | 2666 | VPusdCsugdTgdAacgadAgdAgdAauccasusc | GAUGGAUUCUCUUCGUUCACAGA | 3589 |
| AD-1010675.1 | A-1856353.1 | 2577 | gscsaaa(Ghd)gudCadCaauuuccucaL96 | A-1875213.1 | 2667 | VPusdGsagdGadAauugdTgdAcdCuuugcsusc | GAGCAAAGGUCACAAUUUCCUCA | 3590 |
| AD-961244.1 | A-1812724.1 | 2578 | usgscca(Chd)ugdAadGaaaguacugaL96 | A-1812725.1 | 2668 | VPusdCsagdTadCuuucdTudCadGuggcasasc | GUUGCCACUGAAGAAAGUACUGA | 3591 |
| AD-961295.1 | A-1812826.1 | 2579 | cscsuuc(Chd)ugdAudAugcaguuagaL96 | A-1812827.1 | 2669 | VPusdCsuadAcdTgcaudAudCadGgaaggsasu | AUCCUUCCUGAUAUGCAGUUAGU | 3592 |
| AD-961270.1 | A-1812776.1 | 2580 | csasucu(Uhd)uudCadCaggauuguaaL96 | A-1812777.1 | 2670 | VPusdTsacdAadTccugdTgdAadAagaugsasc | GUCAUCUUUUCACAGGAUUGUAA | 3593 |
| AD-1010683.1 | A-1860792.1 | 2581 | gsgsgag(Ahd)ugdGadTucucuucguaL96 | A-1875221.1 | 2671 | VPusdAscgdAadGagaadTcdCadTcucccscsa | UGGGGAGAUGGAUUCUCUUCGUU | 3594 |
| AD-1010678.1 | A-1858274.1 | 2582 | asasugu(Chd)ggdAcdTugguuaccuaL96 | A-1875216.1 | 2672 | VPusdAsggdTadAccaadGudCcdGacauusasu | AUAAUGUCGGACUUGGUUACCUA | 3595 |
| AD-1010681.1 | A-1860028.1 | 2583 | uscsauc(Chd)ugdGadAguucaguugaL96 | A-1875219.1 | 2673 | VPusdCsaadCudGaacudTcdCadGgaugasasc | GUUCAUCCUGGAAGUUCAGUUGA | 3596 |
| AD-961233.1 | A-1812702.1 | 2584 | asusgua(Uhd)audTudGaccuagugaaL96 | A-1812703.1 | 2674 | VPusdTscadCudAggucdAadAudAuacauscsc | GGAUGUAUAUUUGACCUAGUGAC | 3597 |
| AD-961200.1 | A-1812636.1 | 2585 | asgsuca(Chd)cadCudCagcauucguaL96 | A-1812637.1 | 2675 | VPusdAscgdAadTgcugdAgdTgdGugacusgsa | UCAGUCACCACUCAGCAUUCGUG | 3598 |
| AD-961267.1 | A-1812770.1 | 2586 | asuscgu(Ahd)agdAgdAacucuguagaL96 | A-1812771.1 | 2676 | VPusdCsuadCadGaguudCudCudTacgaususc | GAAUCGUAAGAGAACUCUGUAGG | 3599 |

TABLE 5A-continued

Exemplary Human SCN9A siRNA Modified Single Strands and Duplex Sequences
Column 1 indicates duplex name and the number following the decimal point in a duplex name merely refers to a batch production number. Column 2 indicates the name of the sense sequence. Column 3 indicates the sequence ID for the sequence of column 4. Column 4 provides the modified sequence of a sense strand suitable for use in a duplex described herein. Column 5 indicates the antisense sequence name. Column 6 indicates the sequence ID for the sequence of column 7. Column 7 provides the sequence of a modified antisense strand suitable for use in a duplex described herein, e.g., a duplex comprising the sense sequence in the same row of the table. Column 8 indicates the position in the target mRNA (NM 002977.3) that is complementary to the antisense strand of Column 7. Column 9 indicated the sequence ID for the sequence of column 8.

| Duplex Name | Sense sequence name | Seq ID NO: (sense) | Sense sequence (5'-3') | Antisense sequence name | Seq ID NO: (anti sense) | Antisense sequence (5'-3') | mRNA target sequence in NM_002977.3 | SEQ ID NO: (mRNA target) |
|---|---|---|---|---|---|---|---|---|
| AD-961220.1 | A-1812676.1 | 2587 | gscsuga(Ahd)ccdTadTgaauuccgaaL96 | A-1812677.1 | 2677 | VPusdTscgdGadAuucadTadGgdTucagcscsu | AGGCUGAACCUAUGAAUUCCGAU | 3600 |
| AD-961232.1 | A-1812700.1 | 2588 | csgsgac(Uhd)ugdGudTaccuaucucaL96 | A-1812701.1 | 2678 | VPusdGsagdAudAgguadAcdCadAguccgsasc | GUCGGACUUGGUUACCUAUCUCU | 3601 |
| AD-1010685.1 | A-1860796.1 | 2589 | asgsaug(Ghd)audTcdTcuucguucaaL96 | A-1875223.1 | 2679 | VPusdTsgadAcdGaagadGadAudCcaucuscsc | GGAGAUGGAUUCUCUUCGUUCAC | 3602 |
| AD-1010687.1 | A-1861054.1 | 2590 | asgsacg(Uhd)uadCcdGcuuaaggcaaL96 | A-1875225.1 | 2680 | VPusdTsgcdCudTaagcdGgdTadAcgucusasu | AUAGACGUUACCGCUUAAGGCAA | 3603 |
| AD-961204.1 | A-1812644.1 | 2591 | usgsuag(Ahd)ucdTudGcaauuaccaaL96 | A-1812645.1 | 2681 | VPusdTsggdTadAuugcdAadGadTcuacasasa | UUUGUAGAUCUUGCAAUUACCAU | 3604 |
| AD-961231.1 | A-1812698.1 | 2592 | ususgcc(Chd)uudAudGaauguuaguaL96 | A-1812699.1 | 2682 | VPusdAscudAadCauucdAudAadGggcaasasa | UUUUGCCCUUAUGAAUGUUAGUC | 3605 |

TABLE 5B

Exemplary Human SCN9A Unmodified Single Strands and Duplex Sequences. Column 1 indicates duplex name and the number following the decimal point in a duplex name merely refers to a batch production number. Column 2 indicates the sense sequence name. Column 3 indicates the sequence ID for the sequence of column 4. Column 4 provides the unmodified sequence of a sense strand suitable for use in a duplex described herein. Column 5 provides the position in the target mRNA (NM_002977.3) of the sense strand of Column 4. Column 6 indicates the antisense sequence name. Column 7 indicates the sequence ID for the sequence of column 8. Column 8 provides the sequence of an antisense strand suitable for use in a duplex described herein, without specifying chemical modifications. Column 9 indicates the position in the target mRNA (NM_002977.3) that is complementary to the antisense strand of Column 8.

| Duplex Name | Sense sequence name | Seq ID NO: (sense) | Sense sequence (5'-3') | mRNA target range in NM_ 002977.3 | Anti sense sequence name | Seq ID NO: (anti sense) | antisense sequence (5'-3') | mRNA target range in NM_00297 7.3 |
|---|---|---|---|---|---|---|---|---|
| AD-961208.1 | A-1812652.1 | 2683 | UUGUGACUTUAAGUUUAGUGA | 2752-2772 | A-1812653.1 | 2773 | UCACTAAACUUAAAGTCACAAUA | 2750-2772 |
| AD-961207.1 | A-1812650.1 | 2684 | UAUUGUGACUTUAAGUUUAGA | 2750-2770 | A-1812651.1 | 2774 | UCUAAACUUAAAGTCACAAUAAG | 2748-2770 |
| AD-1010662.1 | A-1851786.1 | 2685 | UUCUGUGUAGGAGAAUUCACA | 867-887 | A-1875200.1 | 2775 | UGUGAATUCUCCUACACAGAAGC | 865-887 |
| AD-961188.1 | A-1812612.1 | 2686 | CAUGAUCUTCTUUGUCGUAGA | 1475-1495 | A-1812613.1 | 2776 | UCUACGACAAAGAAGAUCAUGUA | 1473-1495 |
| AD-1010663.1 | A-1851796.1 | 2687 | UGUAGGAGAATUCACUUUUCA | 872-892 | A-1875201.1 | 2777 | UGAAAAGUGAATUCUCCUACACA | 870-892 |
| AD-1010661.1 | A-1851664.1 | 2688 | UGUCGAGUACACUUUUACUGA | 803-823 | A-1875199.1 | 2778 | UCAGTAAAAGUGUACTCGACAUU | 801-823 |
| AD-961189.1 | A-1812614.1 | 2689 | AUGAUCUUCUTUGUCGUAGUA | 1476-1496 | A-1812615.1 | 2779 | UACUACGACAAAGAAGAUCAUGU | 1474-1496 |
| AD-1010671.1 | A-1853827.1 | 2690 | AUCUGAGACUGAAUUUGCCGA | 2036-2056 | A-1875209.1 | 2780 | UCGGCAAAUUCAGTCTCAGAUCC | 2034-2056 |
| AD-961190.1 | A-1812616.1 | 2691 | UGAUCUUCTUTGUCGUAGUGA | 1477-1497 | A-1812617.1 | 2781 | UCACTACGACAAAGAAGAUCAUG | 1475-1497 |
| AD-961179.1 | A-1812594.1 | 2692 | AAGGGAAAACAAUCUUCCGUA | 619-639 | A-1812595.1 | 2782 | UACGGAAGAUUGUTUTCCCUUUG | 617-639 |
| AD-961342.1 | A-1812920.1 | 2693 | AGCUUGAAGUAAAAUUAGACA | 8697-8717 | A-1812921.1 | 2783 | UGUCTAAUUUUACTUCAAGCUUA | 8695-8717 |
| AD-1010673.1 | A-1854804.1 | 2694 | UGCUAUAGGAAAUUUGGUCUA | 2636-2656 | A-1875211.1 | 2784 | UAGACCAAAUUTCCUAUAGCAAG | 2634-2656 |
| AD-961192.1 | A-1812620.1 | 2695 | AUCUUCUUTGTCGUAGUGAUA | 1479-1499 | A-1812621.1 | 2785 | UAUCACTACGACAAAGAAGAUCA | 1477-1499 |
| AD-961191.1 | A-1812618.1 | 2696 | GAUCUUCUTUGUCGUAGUGAA | 1478-1498 | A-1812619.1 | 2786 | UTCACUACGACAAAGAAGAUCAU | 1476-1498 |
| AD-1010693.1 | A-1863139.1 | 2697 | UUAUUGCATCACUUGUAUACA | 7327-7347 | A-1875231.1 | 2787 | UGUATACAAGUGATGCAAUAAAU | 7325-7347 |
| AD-961334.1 | A-1812904.1 | 2698 | CAACACAATUTCUUCUUAGCA | 8508-8528 | A-1812905.1 | 2788 | UGCUAAGAAGAAATUGUGUUGUU | 8506-8528 |
| AD-1010697.1 | A-1864516.1 | 2699 | CUGUUGGAAATAGGUUUUGAA | 8232-8252 | A-1875235.1 | 2789 | UTCAAAACCUATUTCCAACAGGC | 8230-8252 |
| AD-961203.1 | A-1812642.1 | 2700 | UUUGUAGATCTUGCAAUUACA | 2541-2561 | A-1812643.1 | 2790 | UGUAAUTGCAAGATCTACAAAAG | 2539-2561 |
| AD-1010664.1 | A-1852529.1 | 2701 | UGGUUUCAGCACAGAUUCAGA | 1286-1306 | A-1875202.1 | 2791 | UCUGAATCUGUGCTGAAACCACA | 1284-1306 |
| AD-1010698.1 | A-1865925.1 | 2702 | UUGAUAGUTACCUAGUUUGCA | 9235-9255 | A-1875236.1 | 2792 | UGCAAACUAGGTAACTAUCAAAA | 9233-9255 |

TABLE 5B-continued

Exemplary Human SCN9A Unmodified Single Strands and Duplex Sequences. Column 1 indicates duplex name and the number following the decimal point in a duplex name merely refers to a batch production number. Column 2 indicates the sense sequence name. Column 3 indicates the sequence ID for the sequence of column 4. Column 4 provides the unmodified sequence of a sense strand suitable for use in a duplex described herein. Column 5 provides the position in the target mRNA (NM_002977.3) of the sense strand of Column 4. Column 6 indicates the antisense sequence name. Column 7 indicates the sequence ID for the sequence of column 8. Column 8 provides the sequence of an antisense strand suitable for use in a duplex described herein, without specifying chemical modifications. Column 9 indicates the position in the target mRNA (NM_002977.3) that is complementary to the antisense strand of Column 8.

| Duplex Name | Sense sequence name | Seq ID NO: (sense) | Sense sequence (5'-3') | mRNA target range in NM_ 002977.3 | Anti sense sequence name | Seq ID NO: (anti sense) | antisense sequence (5'-3') | mRNA target range in NM_00297 7.3 |
|---|---|---|---|---|---|---|---|---|
| AD-961187.1 | A-1812610.1 | 2703 | ACAUGAUCUCUUUGUCGUAA | 1474-1494 | A-1812611.1 | 2793 | UUACGACAAAGAAGAUCAUGUAG | 1472-1494 |
| AD-961350.1 | A-1812936.1 | 2704 | GUUUGAACACAAAUCUUUCGA | 9184-9204 | A-1812937.1 | 2794 | UCGAAAGAUUUGUGUTCAAACCU | 9182-9204 |
| AD-1010700.1 | A-1866708.1 | 2705 | UGAGACUGACACAUUGUAAUA | 9710-9730 | A-1875238.1 | 2795 | UAUUACAAUGUGUCAGUCUCAAG | 9708-9730 |
| AD-961182.1 | A-1812600.1 | 2706 | AUGUCGAGTACACUUUUACUA | 802-822 | A-1812601.1 | 2796 | UAGUAAAAGUGTACUCGACAUUU | 800-822 |
| AD-1010699.1 | A-1865927.1 | 2707 | UGAUAGUUACCUAGUUUGCAA | 9236-9256 | A-1875237.1 | 2797 | UTGCAAACUAGGUAACUAUCAAA | 9234-9256 |
| AD-1010696.1 | A-1864159.1 | 2708 | UAUAUUUUACAACAUCCGUUA | 8032-8052 | A-1875234.1 | 2798 | UAACGGAUGUUGUAAAAUAUAUC | 8030-8052 |
| AD-961321.1 | A-1812878.1 | 2709 | CUUUAUACCATCUUAGGUUCA | 8110-8130 | A-1812879.1 | 2799 | UGAACCTAAGAUGGUAUAAAGAA | 8108-8130 |
| AD-961279.1 | A-1812794.1 | 2710 | AUGUACAGAGGUUAUUCUAUA | 6788-6808 | A-1812795.1 | 2800 | UAUAGAAUAACCUCUGUACAUUG | 6786-6808 |
| AD-1010672.1 | A-1854206.1 | 2711 | GCGUUGUAGUTCCUAUCUCCA | 2312-2332 | A-1875210.1 | 2801 | UGGAGATAGGAACTACAACGCCU | 2310-2332 |
| AD-961226.1 | A-1812688.1 | 2712 | AAGUCAAGUCCAAAUCGUUA | 4391-4411 | A-1812689.1 | 2802 | UAACGAUUUGGAACUTGACUUGC | 4389-4411 |
| AD-961225.1 | A-1812686.1 | 2713 | GCAAGUCAAGUCCAAAUCGA | 4389-4409 | A-1812687.1 | 2803 | UCGATUTGGAACUTGACUUGCAG | 4387-4409 |
| AD-1010665.1 | A-1852599.1 | 2714 | UUGGCAGAAACCCUGAUUAUA | 1339-1359 | A-1875203.1 | 2804 | UAUAAUCAGGGTUTCTGCCAAUU | 1337-1359 |
| AD-961259.1 | A-1812754.1 | 2715 | CUGAUUUCCUAAGAAAGGUGA | 6406-6426 | A-1812755.1 | 2805 | UCACCUTUCUUAGGAAAUCAGAG | 6404-6426 |
| AD-961201.1 | A-1812638.1 | 2716 | UCGUGGCUCCUGUUUUCUGA | 1958-1978 | A-1812639.1 | 2806 | UCAGAAAACAAGGAGCCACGAAU | 1956-1978 |
| AD-1010674.1 | A-1854836.1 | 2717 | GUCUUUACTGGAAUCUUUGCA | 2652-2672 | A-1875212.1 | 2807 | UGCAAAGAUUCCAGUAAAGACCA | 2650-2672 |
| AD-1010670.1 | A-1853318.1 | 2718 | CUUCUGAAACAUCCAAACUGA | 1726-1746 | A-1875208.1 | 2808 | UCAGTUTGGAUGUTCAGAAGAA | 1724-1746 |
| AD-961206.1 | A-1812648.1 | 2719 | UUGCUAUAGGAAAUUUGGUCA | 2635-2655 | A-1812649.1 | 2809 | UGACCAAAUUUCCTATAGCAAGU | 2633-2655 |
| AD-961326.1 | A-1812888.1 | 2720 | AGCCUGUUGGAAAUAGGUUUA | 8229-8249 | A-1812889.1 | 2810 | UAAACCTAUUUCCAACAGGCUUG | 8227-8249 |
| AD-961239.1 | A-1812714.1 | 2721 | AUGUUUCUAGCUGAUUUGAUA | 5085-5105 | A-1812715.1 | 2811 | UAUCAAAUCAGCUAGAAACAUAC | 5083-5105 |
| AD-1010660.1 | A-1850886.1 | 2722 | UUGCAAGCCUCUUAUGUGAGA | 286-306 | A-1875198.1 | 2812 | UCUCACAUAAGAGGCTUGCAACC | 284-306 |

TABLE 5B-continued

Exemplary Human SCN9A Unmodified Single Strands and Duplex Sequences. Column 1 indicates duplex name and the number following the decimal point in a duplex name merely refers to a batch production number. Column 2 indicates the sense sequence name. Column 3 indicates the sequence ID for the sequence of column 4. Column 4 provides the unmodified sequence of a sense strand suitable for use in a duplex described herein. Column 5 provides the position in the target mRNA (NM_002977.3) of the sense strand of Column 4. Column 6 indicates the antisense sequence name. Column 7 indicates the sequence ID for the sequence of column 8. Column 8 provides the sequence of an antisense strand suitable for use in a duplex described herein, without specifying chemical modifications. Column 9 indicates the position in the target mRNA (NM_002977.3) that is complementary to the antisense strand of Column 8.

| Duplex Name | Sense sequence name | Seq ID NO: (sense) | Sense sequence (5'-3') | mRNA target range in NM_ 002977.3 | Anti sense sequence name | Seq ID NO: (anti sense) | antisense sequence (5'-3') | mRNA target range in NM_00297 7.3 |
|---|---|---|---|---|---|---|---|---|
| AD-1010677.1 | A-1857611.1 | 2723 | UUUAGUGGCAAACACUCUUGA | 4124-4144 | A-1875215.1 | 2813 | UCAAGAGUGUUTGCCACUAAAGU | 4122-4144 |
| AD-1010690.1 | A-1862528.1 | 2724 | GACUUACCTUTAGAGUAUUGA | 6954-6974 | A-1875228.1 | 2814 | UCAAUACUCUAAAGGTAAGUCUU | 6952-6974 |
| AD-961202.1 | A-1812640.1 | 2725 | GGCGUUGUAGTUCCUAUCUCA | 2311-2331 | A-1812641.1 | 2815 | UGAGAUAGGAACUACAACGCCUU | 2309-2331 |
| AD-1010668.1 | A-1852884.1 | 2726 | UUUGUCGUAGTGAUUUUCCUA | 1485-1505 | A-1875206.1 | 2816 | UAGGAAAAUCACUACGACAAAGA | 1483-1505 |
| AD-1010694.1 | A-1863376.1 | 2727 | CAACUUACTUTCCUAAAUUAA | 7466-7486 | A-1875232.1 | 2817 | UTAAUTUAGGAAAGUAAGUUGGU | 7464-7486 |
| AD-1010679.1 | A-1859377.1 | 2728 | GUAUGUUUCUAGCUGAUUUGA | 5083-5103 | A-1875217.1 | 2818 | UCAAAUCAGCUAGAAACAUACCU | 5081-5103 |
| AD-961257.1 | A-1812750.1 | 2729 | GACAGAGATGAUGAUUUACUA | 6069-6089 | A-1812751.1 | 2819 | UAGUAAAUCAUCAUCTCUGUCUC | 6067-6089 |
| AD-961245.1 | A-1812726.1 | 2730 | GAGAUGGATUCUCUUCGUUCA | 5871-5891 | A-1812727.1 | 2820 | UGAACGAAGAGAAUCCAUCUCCC | 5869-5891 |
| AD-1010692.1 | A-1863006.1 | 2731 | UUCCUGAUAUGCAGUUAGUUA | 7259-7279 | A-1875230.1 | 2821 | UAACTAACUGCAUAUCAGGAAGG | 7257-7279 |
| AD-1010695.1 | A-1863481.1 | 2732 | CACCUUCUCCTUAAAAUUCUA | 7537-7557 | A-1875233.1 | 2822 | UAGAAUTUUAAGGAGAAGGUGAC | 7535-7557 |
| AD-961285.1 | A-1812806.1 | 2733 | CUGAUAAUAGTCUCUUAAACA | 7161-7181 | A-1812807.1 | 2823 | UGUUTAAGAGACUAUTAUCAGUA | 7159-7181 |
| AD-961300.1 | A-1812836.1 | 2734 | CUAAAUUATGGAAGUAAUCUA | 7478-7498 | A-1812837.1 | 2824 | UAGAUUACUUCCAUAAUUUAGGA | 7476-7498 |
| AD-961320.1 | A-1812876.1 | 2735 | UCUUUAUACCAUCUUAGGUUA | 8109-8129 | A-1812877.1 | 2825 | UAACCUAAGAUGGTAUAAAGAAU | 8107-8129 |
| AD-1010684.1 | A-1860794.1 | 2736 | GGAGAUGGAUTCUCUUCGUUA | 5870-5890 | A-1875222.1 | 2826 | UAACGAAGAGAAUCCAUCUCCCC | 5868-5890 |
| AD-1010669.1 | A-1853216.1 | 2737 | UGAAUAUACAAGUAUUAGGAA | 1676-1696 | A-1875207.1 | 2827 | UTCCTAAUACUTGUAUAUUCAGC | 1674-1696 |
| AD-1010680.1 | A-1859383.1 | 2738 | GUUUCUAGCUGAUUUGAUUGA | 5087-5107 | A-1875218.1 | 2828 | UCAAUCAAAUCAGCUAGAAACAU | 5085-5107 |
| AD-961227.1 | A-1812690.1 | 2739 | AGUCAAGUTCCAAAUCGUUCA | 4392-4412 | A-1812691.1 | 2829 | UGAACGAUUUGGAACTUGACUUG | 4390-4412 |
| AD-961243.1 | A-1812722.1 | 2740 | CAUCUGUUGGAAUAUUCUACA | 5506-5526 | A-1812723.1 | 2830 | UGUAGAAUAUUCCAACAGAUGGG | 5504-5526 |
| AD-961221.1 | A-1812678.1 | 2741 | CUGAACCUAUGAAUUCCGAUA | 3736-3756 | A-1812679.1 | 2831 | UAUCGGAAUUCAUAGGUUCAGCC | 3734-3756 |
| AD-961271.1 | A-1812778.1 | 2742 | CUUUUCACAGGAUUGUAAUUA | 6586-6606 | A-1812779.1 | 2832 | UAAUTACAAUCCUGUGAAAAGAU | 6584-6606 |

TABLE 5B-continued

Exemplary Human SCN9A Unmodified Single Strands and Duplex Sequences. Column 1 indicates duplex name and the number following the decimal point in a duplex name merely refers to a batch production number. Column 2 indicates the sense sequence name. Column 3 indicates the sequence ID for the sequence of column 4. Column 4 provides the unmodified sequence of a sense strand suitable for use in a duplex described herein. Column 5 provides the position in the target mRNA (NM_002977.3) of the sense strand of Column 4. Column 6 indicates the antisense sequence name. Column 7 indicates the sequence ID for the sequence of column 8. Column 8 provides the sequence of an antisense strand suitable for use in a duplex described herein, without specifying chemical modifications. Column 9 indicates the position in the target mRNA (NM_002977.3) that is complementary to the antisense strand of Column 8.

| Duplex Name | Sense sequence name | Seq ID NO: (sense) | Sense sequence (5'-3') | mRNA target range in NM_ 002977.3 | Anti sense sequence name | Seq ID NO: (anti sense) | antisense sequence (5'-3') | mRNA target range in NM_00297 7.3 |
|---|---|---|---|---|---|---|---|---|
| AD-961251.1 | A-1812738.1 | 2743 | AGCGUGCUTATAGACGUUACA | 5998-6018 | A-1812739.1 | 2833 | UGUAACGUCUATAAGCACGCUGA | 5996-6018 |
| AD-961296.1 | A-1812828.1 | 2744 | CUUCCUGATATGCAGUUAGUA | 7258-7278 | A-1812829.1 | 2834 | UACUAACUGCAUATCAGGAAGGA | 7256-7278 |
| AD-961246.1 | A-1812728.1 | 2745 | GGAAGAAAGGTUCAUGUCUGA | 5897-5917 | A-1812729.1 | 2835 | UCAGACAUGAACCUTUCUUCCAU | 5895-5917 |
| AD-1010688.1 | A-1861826.1 | 2746 | GUAGAAAACUTUUACAUCUGA | 6557-6577 | A-1875226.1 | 2836 | UCAGAUGUAAAAGTUTUCUACAU | 6555-6577 |
| AD-961269.1 | A-1812774.1 | 2747 | UCAUCUUUTCACAGGAUUGUA | 6582-6602 | A-1812775.1 | 2837 | UACAAUCCUGUGAAAAGAUGACA | 6580-6602 |
| AD-1010691.1 | A-1862804.1 | 2748 | GCCCAAAATACUGAUAAUAGA | 7151-7171 | A-1875229.1 | 2838 | UCUAUUAUCAGTAUTUUGGGCAG | 7149-7171 |
| AD-1010689.1 | A-1861844.1 | 2749 | UUUUACAUCUGCCUUGUCAUA | 6566-6586 | A-1875227.1 | 2839 | UAUGACAAGGCAGAUGUAAAAGU | 6564-6586 |
| AD-1010667.1 | A-1852732.1 | 2750 | UAGGCUAAUGACCCAAGAUUA | 1406-1426 | A-1875205.1 | 2840 | UAAUCUTGGGUCAUUAGCCUAAA | 1404-1426 |
| AD-961252.1 | A-1812740.1 | 2751 | CGUGCUUATAGACGUUACCGA | 6000-6020 | A-1812741.1 | 2841 | UCGGTAACGUCTATAAGCACGCU | 5998-6020 |
| AD-1010666.1 | A-1852704.1 | 2752 | CUUCUUAGCCTUGUUUAGGCA | 1391-1411 | A-1875204.1 | 2842 | UGCCTAAACAAGGCUAAGAAGGC | 1389-1411 |
| AD-1010682.1 | A-1860117.1 | 2753 | UGGAAUAUTCTACUUUGUUAA | 5513-5533 | A-1875220.1 | 2843 | UTAACAAAGUAGAAUAUUCCAAC | 5511-5533 |
| AD-961196.1 | A-1812628.1 | 2754 | CUGAAUAUACAAGUAUUAGGA | 1675-1695 | A-1812629.1 | 2844 | UCCUAATACUUGUAUAUUCAGCC | 1673-1695 |
| AD-1010676.1 | A-1857011.1 | 2755 | CUGCCAAGTUAACAUAGAGUA | 3803-3823 | A-1875214.1 | 2845 | UACUCUAUGUUAACUTGGCAGCA | 3801-3823 |
| AD-1010686.1 | A-1860802.1 | 2756 | UGGAUUCUCUTCGUUCACAGA | 5875-5895 | A-1875224.1 | 2846 | UCUGTGAACGAAGAGAAUCCAUC | 5873-5895 |
| AD-1010675.1 | A-1856353.1 | 2757 | GCAAAGGUCACAAUUUCCUCA | 3448-3468 | A-1875213.1 | 2847 | UGAGGAAAUUGTGACCUUUGCUC | 3446-3468 |
| AD-961244.1 | A-1812724.1 | 2758 | UGCCACUGAAGAAAGUACUGA | 5603-5623 | A-1812725.1 | 2848 | UCAGTACUUUCTUCAGUGGCAAC | 5601-5623 |
| AD-961295.1 | A-1812826.1 | 2759 | CCUUCCUGAUAUGCAGUUAGA | 7257-7277 | A-1812827.1 | 2849 | UCUAACTGCAUAUCAGGAAGGAU | 7255-7277 |
| AD-961270.1 | A-1812776.1 | 2760 | CAUCUUUUCACAGGAUUGUAA | 6583-6603 | A-1812777.1 | 2850 | UTACAATCCUGTGAAAAGAUGAC | 6581-6603 |
| AD-1010683.1 | A-1860792.1 | 2761 | GGGAGAUGGATUCUCUUCGUA | 5869-5889 | A-1875221.1 | 2851 | UACGAAGAGAATCCAUCUCCCCA | 5867-5889 |
| AD-1010678.1 | A-1858274.1 | 2762 | AAUGUCGGACTUGGUUACCUA | 4479-4499 | A-1875216.1 | 2852 | UAGGTAACCAAGUCCGACAUUAU | 4477-4499 |

TABLE 5B-continued

Exemplary Human SCN9A Unmodified Single Strands and Duplex Sequences. Column 1 indicates duplex name and the number following the decimal point in a duplex name merely refers to a batch production number. Column 2 indicates the sense sequence name. Column 3 indicates the sequence ID for the sequence of column 4. Column 4 provides the unmodified sequence of a sense strand suitable for use in a duplex described herein. Column 5 provides the position in the target mRNA (NM_002977.3) of the sense strand of Column 4. Column 6 indicates the antisense sequence name. Column 7 indicates the sequence ID for the sequence of column 8. Column 8 provides the sequence of an antisense strand suitable for use in a duplex described herein, without specifying chemical modifications. Column 9 indicates the position in the target mRNA (NM_002977.3) that is complementary to the antisense strand of Column 8.

| Duplex Name | Sense sequence name | Seq ID NO: (sense) | Sense sequence (5'-3') | mRNA target range in NM_ 002977.3 | Anti sense sequence name | Seq ID NO: (anti sense) | antisense sequence (5'-3') | mRNA target range in NM_00297 7.3 |
|---|---|---|---|---|---|---|---|---|
| AD-1010681.1 | A-1860028.1 | 2763 | UCAUCCUGGAAGUUCAGUUGA | 5468-5488 | A-1875219.1 | 2853 | UCAACUGAACUTCCAGGAUGAAC | 5466-5488 |
| AD-961233.1 | A-1812702.1 | 2764 | AUGUAUAUTUGACCUAGUGAA | 4826-4846 | A-1812703.1 | 2854 | UTCACUAGGUCAAAUAUACAUCC | 4824-4846 |
| AD-961200.1 | A-1812636.1 | 2765 | AGUCACCACUCAGCAUUCGUA | 1942-1962 | A-1812637.1 | 2855 | UACGAATGCUGAGTGGUGACUGA | 1940-1962 |
| AD-961267.1 | A-1812770.1 | 2766 | AUCGUAAGAGAACUCUGUAGA | 6472-6492 | A-1812771.1 | 2856 | UCUACAGAGUUCUCUTACGAUUC | 6470-6492 |
| AD-961220.1 | A-1812676.1 | 2767 | GCUGAACCTATGAAUUCCGAA | 3735-3755 | A-1812677.1 | 2857 | UTCGGAAUUCATAGGTUCAGCCU | 3733-3755 |
| AD-961232.1 | A-1812700.1 | 2768 | CGGACUUGGUTACCUAUCUCA | 4484-4504 | A-1812701.1 | 2858 | UGAGAUAGGUAACCAAGUCCGAC | 4482-4504 |
| AD-1010685.1 | A-1860796.1 | 2769 | AGAUGGAUTCTCUUCGUUCAA | 5872-5892 | A-1875223.1 | 2859 | UTGAACGAAGAGAAUCCAUCUCC | 5870-5892 |
| AD-1010687.1 | A-1861054.1 | 2770 | AGACGUUACCGCUUAAGGCAA | 6009-6029 | A-1875225.1 | 2860 | UTGCCUTAAGCGGTAACGUCUAU | 6007-6029 |
| AD-961204.1 | A-1812644.1 | 2771 | UGUAGAUCTUGCAAUUACCAA | 2543-2563 | A-1812645.1 | 2861 | UTGGTAAUUGCAAGATCUACAAA | 2541-2563 |
| AD-961231.1 | A-1812698.1 | 2772 | UUGCCCUUAUGAAUGUUAGUA | 4420-4440 | A-1812699.1 | 2862 | UACUAACAUUCAUAAGGGCAAAA | 4418-4440 |

TABLE 6A

Exemplary Human SCN9A siRNA Modified Single Strands and Duplex Sequences Column 1 indicates duplex name and the number following the decimal pointin a duplex name merely refers to a batch production number. Column 2 indicates the name of the sense sequence. Column 3 indicates the sequence ID for the sequence of column 4. Column 4 provides the modified sequence of a sense strand suitable for use in a duplex described herein. Column 5 indicates the antisense sequence name. Column 6 indicates the sequence ID for the sequence of column 7. Column 7 provides the sequence of a modified antisense strand suitable for use in a duplex described herein, e.g., a duplex comprising the sense sequence in the same row of the table. Column 8 indicates the position in the target mRNA (NM_001365536.1) that is complementary to the antisense strand of Column 7. Column 9 indicated the sequence ID for the sequence of column 8.

| Duplex Name | Sense sequence name | Seq ID NO: (sense) | Sense sequence (5'-3') | Antisense sequence name | Seq ID NO: (anti sense) | Antisense sequence (5'-3') | mRNA target sequence in NM_0013 65536.1 | SEQ ID NO: (mRNA target) |
|---|---|---|---|---|---|---|---|---|
| AD-996318.1 | A-1525247.1 | 5816 | gsgscgu(Uhd)GfuAfGfUfuccuaucucaL96 | A-1240821.1 | 5905 | VPusGfsagau(Agn)ggaacuAfcAfacgccsusu | AAGGCGUUGUAGUUCCUAUCUCC | 3606 |

TABLE 6A-continued

Exemplary Human SCN9A siRNA Modified Single Strands and Duplex Sequences Column 1 indicates duplex name and the number following the decimal pointin a duplex name merely refers to a batch production number. Column 2 indicates the name of the sense sequence. Column 3 indicates the sequence ID for the sequence of column 4. Column 4 provides the modified sequence of a sense strand suitable for use in a duplex described herein. Column 5 indicates the antisense sequence name. Column 6 indicates the sequence ID for the sequence of column 7. Column 7 provides the sequence of a modified antisense strand suitable for use in a duplex described herein, e.g., a duplex comprising the sense sequence in the same row of the table. Column 8 indicates the position in the target mRNA (NM_001365536.1) that is complementary to the antisense strand of Column 7. Column 9 indicated the sequence ID for the sequence of column 8.

| Duplex Name | Sense sequence name | Seq ID NO: (sense) | Sense sequence (5'-3') | Antisense sequence name | Seq ID NO: (anti sense) | Antisense sequence (5'-3') | mRNA target sequence in NM_001365536.1 | SEQ ID NO: (mRNA target) |
|---|---|---|---|---|---|---|---|---|
| AD-995116.1 | A-1522818.1 | 5817 | ususcug(Uhd)GfuAfGfGfagaauucacaL96 | A-1238317.1 | 5906 | VPusGfsugaa(Tgn)ucuccuAfcAfcagaasgsc | GCUUCUGUGUAGGAGAAUUCACU | 3607 |
| AD-995486.1 | A-1523509.1 | 5818 | usgsguu(Uhd)CfaGfCfAfcagauucagaL96 | A-1239063.1 | 5907 | VPusCfsugaa(Tgn)cugugcUfgAfaaccascsa | UGUGGUUUCAGCACAGAUUCAGG | 3608 |
| AD-995121.1 | A-1522828.1 | 5819 | usgsuag(Ghd)AfgAfAfUfucacuuuucaL96 | A-1238327.1 | 5908 | VPusGfsaaaa(Ggn)ugaauuCfuCfcuacascsa | UGUGUAGGAGAAUUCACUUUUCU | 3609 |
| AD-961022.1 | A-1525636.1 | 5820 | usususgu(Ahd)GfaUfCfUfugcaauuacaL96 | A-1241249.1 | 5909 | VPusGfsuaau(Tgn)gcaagaUfcUfacaaasasg | CUUUUGUAGAUCUUGCAAUUACC | 3610 |
| AD-1002051.1 | A-1536779.1 | 5821 | gsusuug(Ahd)AfcAfCfAfaaucuuucgaL96 | A-1252583.1 | 5910 | VPusCfsgaaa(Ggn)auuuguGfuUfcaaacscsu | AGGUUUGAACACAAAUCUUUCGG | 3611 |
| AD-995873.1 | A-1524297.1 | 5822 | csusucu(Ghd)AfaAfCfAfuccaaacugaL96 | A-1239861.1 | 5911 | VPusCfsaguu(Tgn)ggauguUfuCfagaagsasa | UUCUUCUGAAACAUCCAAACUGA | 3612 |
| AD-961040.1 | A-1529029.1 | 5823 | asgsuca(Ahd)GfuUfCfCfaaaucguucaL96 | A-1244745.1 | 5912 | VPusGfsaacg(Agn)uuuggaAfcUfugacususg | CAAGUCAAGUUCCAAAUCGUUCC | 3613 |
| AD-961013.1 | A-1523849.1 | 5824 | gsasucu(Uhd)CfuUfUfGfucguagugaaL96 | A-1239411.1 | 5913 | VPusUfscacu(Agn)cgacaaAfgAfagaucsasu | AUGAUCUUCUUUGUCGUAGUGAU | 3614 |
| AD-995055.1 | A-1522697.1 | 5825 | usgsucg(Ahd)GfuAfCfAfcuuuuacugaL96 | A-1238195.1 | 5914 | VPusCfsagua(Agn)aaguguAfcUfcgacasusu | AAUGUCGAGUACACUUUUACUGG | 3615 |
| AD-961010.1 | A-1523843.1 | 5826 | csasuga(Uhd)CfuUfCfUfuugucguagaL96 | A-1239405.1 | 5915 | VPusCfsuacg(Agn)caaagaAfgAfucaugsusa | UACAUGAUCUUCUUUGUCGUAGU | 3616 |
| AD-961000.1 | A-1522351.1 | 5827 | asasggg(Ahd)AfaAfCfAfaucuuccguaL96 | A-1237849.1 | 5916 | VPusAfscgga(Agn)gauuguUfuUfcccuususg | CAAAGGGAAAACAAUCUUCCGUU | 3617 |
| AD-999598.1 | A-1531657.1 | 5828 | asgsaug(Ghd)AfuUfCfUfcuucguucaaL96 | A-1247453.1 | 5917 | VPusUfsgaac(Ggn)aagagaAfuCfcaucuscsc | GGAGAUGGAUUCUCUUCGUUCAC | 3618 |
| AD-1002101.1 | A-1536879.1 | 5829 | usgsaua(Ghd)UfuAfCfCfuaguuugcaaL96 | A-1252683.1 | 5918 | VPusUfsgcaa(Agn)cuagguAfaCfuaucasasa | UUUGAUAGUUACCUAGUUUGCAA | 3619 |
| AD-1001246.1 | A-1535071.1 | 5830 | usasuau(Uhd)UfuAfCfAfcauccguuaL96 | A-1250879.1 | 5919 | VPusAfsacgg(Agn)uguguAfaAfauauasusc | GAUAUAUUUUACAACAUCCGUUA | 3620 |
| AD-996618.1 | A-1525802.1 | 5831 | ususgcu(Ahd)UfaGfGfAfaauuuggucaL96 | A-1241423.1 | 5920 | VPusGfsacca(Agn)auuuccUfaUfagcaasgsu | ACUUGCUAUAGGAAAUUUGGUCU | 3621 |

TABLE 6A-continued

Exemplary Human SCN9A siRNA Modified Single Strands and Duplex Sequences
Column 1 indicates duplex name and the number following the decimal pointin a duplex name merely refers to a batch production number. Column 2 indicates the name of the sense sequence. Column 3 indicates the sequence ID for the sequence of column 4. Column 4 provides the modified sequence of a sense strand suitable for use in a duplex described herein. Column 5 indicates the antisense sequence name. Column 6 indicates the sequence ID for the sequence of column 7. Column 7 provides the sequence of a modified antisense strand suitable for use in a duplex described herein, e.g., a duplex comprising the sense sequence in the same row of the table. Column 8 indicates the position in the target mRNA (NM_001365536.1) that is complementary to the antisense strand of Column 7. Column 9 indicated the sequence ID for the sequence of column 8.

| Duplex Name | Sense sequence name | Seq ID NO: (sense) | Sense sequence (5'-3') | Antisense sequence name | Seq ID NO: (anti sense) | Antisense sequence (5'-3') | mRNA target sequence in NM_001365536.1 | SEQ ID NO: (mRNA target) |
|---|---|---|---|---|---|---|---|---|
| AD-961014.1 | A-1523851.1 | 5832 | asuscuu(Chd)UfuUfGfUfcguagugauaL96 | A-1239413.1 | 5921 | VPusAfsucac(Tgn)acgacaAfaGfaagauscsa | UGAUCUUCUUUGUCGUAGUGAUU | 3622 |
| AD-1000046.1 | A-1532577.1 | 5833 | asuscgu(Ahd)AfgAfGfAfacucuguagaL96 | A-1248385.1 | 5922 | VPusCfsuaca(Ggn)aguucuCfuUfacgaususc | GAAUCGUAAGAGAACUCUGUAGG | 3623 |
| AD-996319.1 | A-1525249.1 | 5834 | gscsguu(Ghd)UfaGfUfUfccuaucuccaL96 | A-1240823.1 | 5923 | VPusGfsgaga(Tgn)aggaacUfaCfaacgcscsu | AGGCGUUGUAGUUCCUAUCUCCU | 3624 |
| AD-961011.1 | A-1523845.1 | 5835 | asusgau(Chd)UfuCfUfUfugucguaguaL96 | A-1239407.1 | 5924 | VPusAfscuac(Ggn)acaaagAfaGfaucausgsu | ACAUGAUCUUCUUUGUCGUAGUG | 3625 |
| AD-1002409.1 | A-1537499.1 | 5836 | gscsugu(Uhd)UfaCfAfUfaggauucuuaL96 | A-1253305.1 | 5925 | VPusAfsagaa(Tgn)ccuaugUfaAfacagcsusu | AAGCUGUUUACAUAGGAUUCUUU | 3626 |
| AD-1000916.1 | A-1534385.1 | 5837 | csasccu(Uhd)CfuCfCfUfuaaaauucuaL96 | A-1250193.1 | 5926 | VPusAfsgaau(Tgn)uuaaggAfgAfaggugsasc | GUCACCUUCUCCUUAAAAUUCUA | 3627 |
| AD-996733.1 | A-1526036.1 | 5838 | ususgug(Ahd)CfuUfUfAfaguuuagugaL96 | A-1241657.1 | 5927 | VPusCfsacua(Agn)acuuaaAfgUfcacaasusa | UAUUGUGACUUUAAGUUUAGUGG | 3628 |
| AD-961137.1 | A-1535225.1 | 5839 | uscsuuu(Ahd)UfaCfCfAfucuuagguuaL96 | A-1251033.1 | 5928 | VPusAfsaccu(Agn)agauggUfaUfaaagasasu | AUUCUUUAUACCAUCUUAGGUUC | 3629 |
| AD-961057.1 | A-1531655.1 | 5840 | gsasgau(Ghd)GfaUfUfCfucuucguucaL96 | A-1247451.1 | 5929 | VPusGfsaacg(Agn)agagaaUfcCfaucucscsc | GGGAGAUGGAUUCUCUUCGUUCA | 3630 |
| AD-1002100.1 | A-1536877.1 | 5841 | ususgau(Ahd)GfuUfAfCfcuaguuugcaL96 | A-1252681.1 | 5930 | VPusGfscaaa(Cgn)uagguaAfcUfaucaasasa | UUUUGAUAGUUACCUAGUUUGCA | 3631 |
| AD-999762.1 | A-1531997.1 | 5842 | gsascag(Ahd)GfaUfGfAfugauuuacuaL96 | A-1247805.1 | 5931 | VPusAfsguaa(Agn)ucaucaUfcUfcugucsusc | GAGACAGAGAUGAUGAUUUACUC | 3632 |
| AD-961085.1 | A-1533099.1 | 5843 | asusgua(Chd)AfgAfGfGfuuauucuauaL96 | A-1248907.1 | 5932 | VPusAfsuaga(Agn)uaaccuCfuGfuacausgsg | CAAUGUACAGAGGUUAUUCUAUA | 3633 |
| AD-961049.1 | A-1530270.1 | 5844 | asusguu(Uhd)CfuAfGfCfugauuugauaL96 | A-1246031.1 | 5933 | VPusAfsucaa(Agn)ucagcuAfgAfaacausasc | GUAUGUUUCUAGCUGAUUUGAUU | 3634 |
| AD-961155.1 | A-1535805.1 | 5845 | csasaca(Chd)AfaUfUfUfcuucuuagcaL96 | A-1251613.1 | 5934 | VPusGfscuaa(Ggn)aagaaaUfuGfuguugsusu | AACAACACAAUUUCUUCUUAGCA | 3635 |
| AD-961039.1 | A-1529023.1 | 5846 | gscsaag(Uhd)CfaAfGfUfuccaaaucgaL96 | A-1244739.1 | 5935 | VPusCfsgauu(Tgn)ggaacuUfgAfcuugcsasg | CUGCAAGUCAAGUCCAAAUCGU | 3636 |

TABLE 6A-continued

Exemplary Human SCN9A siRNA Modified Single Strands and Duplex Sequences
Column 1 indicates duplex name and the number following the decimal pointin a duplex name merely refers to a batch production number.
Column 2 indicates the name of the sense sequence. Column 3 indicates the sequence ID for the sequence of column 4. Column 4 provides the modified sequence of a sense strand suitable for use in a duplex described herein. Column 5 indicates the antisense sequence name.
Column 6 indicates the sequence ID for the sequence of column 7.
Column 7 provides the sequence of a modified antisense strand suitable for use in a duplex described herein, e.g., a duplex comprising the sense sequence in the same row of the table.
Column 8 indicates the position in the target mRNA (NM_001365536.1) that is complementary to the antisense strand of Column 7.
Column 9 indicated the sequence ID for the sequence of column 8.

| Duplex Name | Sense sequence name | Seq ID NO: (sense) | Sense sequence (5'-3') | Antisense sequence name | Seq ID NO: (anti sense) | Antisense sequence (5'-3') | mRNA target sequence in NM_001365536.1 | SEQ ID NO: (mRNA target) |
|---|---|---|---|---|---|---|---|---|
| AD-998346.1 | A-1529197.1 | 5847 | asasugu(Chd)GfgAfCfUfugguuaccuaL96 | A-1244919.1 | 5936 | VPusAfsggua(Agn)ccaaguCfcGfacauusasu | AUAAUGUCGGACUUGGUUACCUA | 3637 |
| AD-961056.1 | A-1530988.1 | 5848 | csasucu(Ghd)UfuGfGfAfauauucuacaL96 | A-1246759.1 | 5937 | VPusGfsuaga(Agn)uauuccAfaCfagaugsgsg | CCCAUCUGUUGGAAUAUUCUACU | 3638 |
| AD-999259.1 | A-1531002.1 | 5849 | usgsgaa(Uhd)AfuUfCfUfacuuuguuaaL96 | A-1246773.1 | 5938 | VPusUfsaaca(Agn)aguagaAfuAfuuccasasc | GUUGGAAUAUUCUACUUUGUUAG | 3639 |
| AD-961093.1 | A-1533709.1 | 5850 | csusgau(Ahd)AfuAfGfUfcucuuaaacaL96 | A-1249517.1 | 5939 | VPusGfsuuua(Agn)gagacuAfuUfaucagsusa | UACUGAUAAUAGUCUCUUAAACU | 3640 |
| AD-995521.1 | A-1523579.1 | 5851 | ususggc(Ahd)GfaAfAfCfccugauuauaL96 | A-1239133.1 | 5940 | VPusAfsuaau(Cgn)aggguuUfcUfgccaasusu | AAUUGGCAGAAACCCUGAUUAUG | 3641 |
| AD-997386.1 | A-1527312.1 | 5852 | gscsaaa(Ghd)GfuCfAfCfaauuuccucaL96 | A-1242983.1 | 5941 | VPusGfsagga(Agn)auugugAfcCfuuugcsusc | GAGCAAAGGUCACAAUUUCCUCA | 3642 |
| AD-961037.1 | A-1527831.1 | 5853 | csusgaa(Chd)CfuAfUfGfaauuccgauaL96 | A-1243513.1 | 5942 | VPusAfsucgg(Agn)auucauAfgGfuucagscsc | GGCUGAACCUAUGAAUUCCGAUG | 3643 |
| AD-961058.1 | A-1531697.1 | 5854 | gsgsaag(Ahd)AfaGfGfUfucaugucugaL96 | A-1247503.1 | 5943 | VPusCfsagac(Agn)ugaaccUfuUfcuuccsasu | AUGGAAGAAAGGUUCAUGUCUGC | 3644 |
| AD-961146.1 | A-1535441.1 | 5855 | asgsccu(Ghd)UfuGfGfAfaauagguuuaL96 | A-1251249.1 | 5944 | VPusAfsaacc(Tgn)auuuccAfaCfaggcusgsg | CAAGCCUGUUGGAAAUAGGUUUU | 3645 |
| AD-1000747.1 | A-1534041.1 | 5856 | ususauu(Ghd)CfaUfCfAfcuuguauacaL96 | A-1249849.1 | 5945 | VPusGfsuaua(Cgn)aagugaUfgCfaauaasasu | AUUUAUUGCAUCACUUGUAUACA | 3646 |
| AD-1001409.1 | A-1535447.1 | 5857 | csusguu(Ghd)GfaAfAfUfagguuuugaaL96 | A-1251255.1 | 5946 | VPusUfscaaa(Agn)ccuauuUfcCfaacagsgsc | GCCUGUUGGAAAUAGGUUUUGAU | 3647 |
| AD-996130.1 | A-1524811.1 | 5858 | asuscug(Ahd)GfaCfUfGfaauuugccgaL96 | A-1240377.1 | 5947 | VPusCfsggca(Agn)auucagUfcUfcagauscsc | GGAUCUGAGACUGAAUUUGCCGA | 3648 |
| AD-999715.1 | A-1531895.1 | 5859 | asgscgu(Ghd)CfuUfAfUfagacguuacaL96 | A-1247701.1 | 5948 | VPusGfsuaac(Ggn)ucuauaAfgCfacgcusgsa | UCAGCGUGCUUAUAGACGUUACC | 3649 |
| AD-1000678.1 | A-1533901.1 | 5860 | cscsuuc(Chd)UfgAfUfAfugcaguuagaL96 | A-1249709.1 | 5949 | VPusCfsuaac(Tgn)gcauauCfaGfgaaggsasu | AUCCUUCCUGAUAUGCAGUUAGU | 3650 |
| AD-1000106.1 | A-1532699.1 | 5861 | gsusaga(Ahd)AfaCfUfUfuacaucugaL96 | A-1248507.1 | 5950 | VPusCfsagau(Ggn)uaaaagUfuUfucuacsasu | AUGUAGAAAACUUUUACAUCUGC | 3651 |

TABLE 6A-continued

Exemplary Human SCN9A siRNA Modified Single Strands and Duplex Sequences Column 1 indicates duplex name and the number following the decimal pointin a duplex name merely refers to a batch production number. Column 2 indicates the name of the sense sequence. Column 3 indicates the sequence ID for the sequence of column 4. Column 4 provides the modified sequence of a sense strand suitable for use in a duplex described herein. Column 5 indicates the antisense sequence name. Column 6 indicates the sequence ID for the sequence of column 7. Column 7 provides the sequence of a modified antisense strand suitable for use in a duplex described herein, e.g., a duplex comprising the sense sequence in the same row of the table. Column 8 indicates the position in the target mRNA (NM_001365536.1) that is complementary to the antisense strand of Column 7. Column 9 indicated the sequence ID for the sequence of column 8.

| Duplex Name | Sense sequence name | Seq ID NO: (sense) | Sense sequence (5'-3') | Antisense sequence name | Seq ID NO: (anti sense) | Antisense sequence (5'-3') | mRNA target sequence in NM_001365536.1 | SEQ ID NO: (mRNA target) |
|---|---|---|---|---|---|---|---|---|
| AD-1000585.1 | A-1533689.1 | 5862 | gscscca(Ahd)AfaUfAfCfugauaauagaL96 | A-1249497.1 | 5951 | VPusCfsuauu(Agn)ucaguaUfuUfugggcsasg | CUGCCCAAAAUACUGAUAAUAGU | 3652 |
| AD-996635.1 | A-1525836.1 | 5863 | gsuscuu(Uhd)AfcUfGfGfaaucuuugcaL96 | A-1241457.1 | 5952 | VPusGfscaaa(Ggn)auuccaGfuAfaagacscsa | UGGUCUUUACUGGAAUCUUUGCA | 3653 |
| AD-961163.1 | A-1536023.1 | 5864 | asgscuu(Ghd)AfaGfUfAfaaauuagacaL96 | A-1251831.1 | 5953 | VPusGfsucua(Agn)uuuuacUfuCfaagcususa | UAAGCUUGAAGUAAAAUUAGACC | 3654 |
| AD-999601.1 | A-1531663.1 | 5865 | usgsgau(Uhd)CfuCfUfUfcguucacagaL96 | A-1247459.1 | 5954 | VPusCfsugug(Agn)acgaagAfgAfauccasusc | GAUGGAUUCUCUUCGUUCACAGA | 3655 |
| AD-998015.1 | A-1528540.1 | 5866 | ususuag(Uhd)GfgCfAfAfacacucuugaL96 | A-1244249.1 | 5955 | VPusCfsaaga(Ggn)uguuugCfcAfcuaaasgsu | ACUUUAGUGGCAAACACUCUUGG | 3656 |
| AD-961009.1 | A-1523841.1 | 5867 | ascsaug(Ahd)UfcUfUfCfuuugucguaaL96 | A-1239403.1 | 5956 | VPusUfsacga(Cgn)aaagaaGfaUfcaugusasg | CUACAUGAUCUUCUUUGUCGUAG | 3657 |
| AD-961078.1 | A-1532751.1 | 5868 | csasucu(Uhd)UfuCfAfCfaggauuguaaL96 | A-1248559.1 | 5957 | VPusUfsacaa(Tgn)ccugugAfaAfagaugsasc | GUCAUCUUUUCACAGGAUUGUAA | 3658 |
| AD-999986.1 | A-1532445.1 | 5869 | csusgau(Uhd)UfcCfUfAfagaaaggugaL96 | A-1248253.1 | 5958 | VPusCfsaccu(Tgn)ucuuagGfaAfaucagsasg | CUCUGAUUUCCUAAGAAAGGUGG | 3659 |
| AD-961138.1 | A-1535227.1 | 5870 | csusuua(Uhd)AfcCfAfUfcuuagguucaL96 | A-1251035.1 | 5959 | VPusGfsaacc(Tgn)aagaugGfuAfuaaagsasa | UUCUUUAUACCAUCUUAGGUUCA | 3660 |
| AD-961066.1 | A-1531899.1 | 5871 | csgsugc(Uhd)UfaUfAfGfacguuaccgaL96 | A-1247705.1 | 5960 | VPusCfsggua(Agn)cgucuaUfaAfgcacgscsu | AGCGUGCUUAUAGACGUUACCGC | 3661 |
| AD-998261.1 | A-1529027.1 | 5872 | asasguc(Ahd)AfgUfUfCfcaaaucguuaL96 | A-1244743.1 | 5961 | VPusAfsacga(Tgn)uuggaaCfuUfgacuusgsc | GCAAGUCAAGUUCCAAAUCGUUC | 3662 |
| AD-995823.1 | A-1524195.1 | 5873 | csusgaa(Uhd)AfuAfCfAfaguauuaggaL96 | A-1239759.1 | 5962 | VPusCfscuaa(Tgn)acuuguAfuAfuucagscsc | GGCUGAAUAUACAAGUAUUAGGA | 3663 |
| AD-996052.1 | A-1524655.1 | 5874 | uscsgug(Ghd)CfuCfCfUfuguuuucugaL96 | A-1240221.1 | 5963 | VPusCfsagaa(Agn)acaaggAfgCfcacgasasu | AUUCGUGGCUCCUUGUUUUCUGC | 3664 |
| AD-999721.1 | A-1531917.1 | 5875 | asgsacg(Uhd)UfaCfCfGfcuuaaggcaaL96 | A-1247723.1 | 5964 | VPusUfsgccu(Tgn)aagcggUfaAfcgucusasu | AUAGACGUUACCGCUUAAGGCAA | 3665 |
| AD-1000130.1 | A-1532749.1 | 5876 | uscsauc(Uhd)UfuUfCfAfcaggauuguaL96 | A-1248557.1 | 5965 | VPusAfscaau(Cgn)cugugaAfaAfgaugascsa | UGUCAUCUUUUCACAGGAUUGUA | 3666 |

TABLE 6A-continued

Exemplary Human SCN9A siRNA Modified Single Strands and Duplex Sequences
Column 1 indicates duplex name and the number following the decimal pointin a duplex name merely refers to a batch production number. Column 2 indicates the name of the sense sequence. Column 3 indicates the sequence ID for the sequence of column 4. Column 4 provides the modified sequence of a sense strand suitable for use in a duplex described herein. Column 5 indicates the antisense sequence name. Column 6 indicates the sequence ID for the sequence of column 7. Column 7 provides the sequence of a modified antisense strand suitable for use in a duplex described herein, e.g., a duplex comprising the sense sequence in the same row of the table. Column 8 indicates the position in the target mRNA (NM_001365536.1) that is complementary to the antisense strand of Column 7. Column 9 indicated the sequence ID for the sequence of column 8.

| Duplex Name | Sense sequence name | Seq ID NO: (sense) | Sense sequence (5'-3') | Antisense sequence name | Seq ID NO: (anti sense) | Antisense sequence (5'-3') | mRNA target sequence in NM_001365536.1 | SEQ ID NO: (mRNA target) |
|---|---|---|---|---|---|---|---|---|
| AD-1000115.1 | A-1532717.1 | 5877 | ususuua(Chd)AfuCfUfGfccuugucauaL96 | A-1248525.1 | 5966 | VPusAfsugac(Agn)aggcagAfuGfuaaaasgsu | ACUUUUACAUCUGCCUUGUCAUC | 3667 |
| AD-961106.1 | A-1533903.1 | 5878 | csusucc(Uhd)GfaUfAfUfgcaguuaguaL96 | A-1249711.1 | 5967 | VPusAfscuaa(Cgn)ugcauaUfcAfggaagsgsa | UCCUUCCUGAUAUGCAGUUAGUU | 3668 |
| AD-995824.1 | A-1524197.1 | 5879 | usgsaau(Ahd)UfaCfAfAfguauuaggaaL96 | A-1239761.1 | 5968 | VPusUfsccua(Agn)uacuugUfaUfauucasgsc | GCUGAAUAUACAAGUAUUAGGAG | 3669 |
| AD-998897.1 | A-1530274.1 | 5880 | gsusuuc(Uhd)AfgCfUfGfauuugauugaL96 | A-1246035.1 | 5969 | VPusCfsaauc(Agn)aaucagCfuAfgaaacsasu | AUGUUUCUAGCUGAUUUGAUUGA | 3670 |
| AD-999348.1 | A-1531160.1 | 5881 | usgscca(Chd)UfgAfAfGfaaaguacugaL96 | A-1246951.1 | 5970 | VPusCfsagua(Cgn)uuucuuCfaGfuggcasasc | GUUGCCACUGAAGAAAGUACUGA | 3671 |
| AD-961012.1 | A-1523847.1 | 5882 | usgsauc(Uhd)UfcUfUfUfgucguagugaL96 | A-1239409.1 | 5971 | VPusCfsacua(Cgn)gacaaaGfaAfgaucasusg | CAUGAUCUUCUUUGUCGUAGUGA | 3672 |
| AD-999215.1 | A-1530912.1 | 5883 | uscsauc(Chd)UfgGfAfAfguucaguugaL96 | A-1246683.1 | 5972 | VPusCfsaacu(Ggn)aacuucCfaGfgaugasasc | GUUCAUCCUGGAAGUUCAGUUGA | 3673 |
| AD-961044.1 | A-1529794.1 | 5884 | asusgua(Uhd)AfuUfUfGfaccuagugaaL96 | A-1245553.1 | 5973 | VPusUfscacu(Agn)ggucaaAfuAfuacauscsc | GGAUGUAUAUUUGACCUAGUGAC | 3674 |
| AD-961004.1 | A-1522695.1 | 5885 | asusguc(Ghd)AfgUfAfCfacuuuuacuaL96 | A-1238193.1 | 5974 | VPusAfsguaa(Agn)aguguaCfuCfgacaususu | AAAUGUCGAGUACACUUUUACUG | 3675 |
| AD-961024.1 | A-1526032.1 | 5886 | usasuug(Uhd)GfaCfUfUfuaaguuuagaL96 | A-1241653.1 | 5975 | VPusCfsuaaa(Cgn)uuaaagUfcAfcaauasasg | CUUAUUGUGACUUUAAGUUUAGU | 3676 |
| AD-998894.1 | A-1530266.1 | 5887 | gsusaug(Uhd)UfuCfUfAfgcugauuugaL96 | A-1246027.1 | 5976 | VPusCfsaaau(Cgn)agcuagAfaAfcauacscsu | AGGUAUGUUUCUAGCUGAUUUGA | 3677 |
| AD-999596.1 | A-1531651.1 | 5888 | gsgsgag(Ahd)UfgGfAfUfucucuucguaL96 | A-1247447.1 | 5977 | VPusAfscgaa(Ggn)agaaucCfaUfcucccscsa | UGGGGAGAUGGAUUCUCUUCGUU | 3678 |
| AD-1000679.1 | A-1533905.1 | 5889 | ususccu(Ghd)AfuAfUfGfcaguuaguuaL96 | A-1249713.1 | 5978 | VPusAfsacua(Agn)cugcauAfuCfaggaasgsg | CCUUCCUGAUAUGCAGUUAGUUG | 3679 |
| AD-1000864.1 | A-1534279.1 | 5890 | csasacu(Uhd)AfcUfUfUfccuaaauuaaL96 | A-1250087.1 | 5979 | VPusUfsaauu(Tgn)aggaaaGfuAfaguugsgsu | ACCAACUUACUUUCCUAAAUUAU | 3680 |
| AD-996619.1 | A-1525804.1 | 5891 | usgscua(Uhd)AfgGfAfAfauuuggucuaL96 | A-1241425.1 | 5980 | VPusAfsgacc(Agn)aauuucCfuAfuagcasasg | CUUGCUAUAGGAAAUUUGGUCUU | 3681 |

TABLE 6A-continued

Exemplary Human SCN9A siRNA Modified Single Strands and Duplex Sequences Column 1 indicates duplex name and the number following the decimal pointin a duplex name merely refers to a batch production number. Column 2 indicates the name of the sense sequence. Column 3 indicates the sequence ID for the sequence of column 4. Column 4 provides the modified sequence of a sense strand suitable for use in a duplex described herein. Column 5 indicates the antisense sequence name. Column 6 indicates the sequence ID for the sequence of column 7. Column 7 provides the sequence of a modified antisense strand suitable for use in a duplex described herein, e.g., a duplex comprising the sense sequence in the same row of the table. Column 8 indicates the position in the target mRNA (NM_001365536.1) that is complementary to the antisense strand of Column 7. Column 9 indicated the sequence ID for the sequence of column 8.

| Duplex Name | Sense sequence name | Seq ID NO: (sense) | Sense sequence (5'-3') | Antisense sequence name | Seq ID NO: (anti sense) | Antisense sequence (5'-3') | mRNA target sequence in NM_001365536.1 | SEQ ID NO: (mRNA target) |
|---|---|---|---|---|---|---|---|---|
| AD-961109.1 | A-1534303.1 | 5892 | csusaaa(Uhd)UfaUfGfGfaaguaaucuaL96 | A-1250111.1 | 5981 | VPusAfsgauu(Agn)cuuccaUfaAfuuuagsgsa | UCCUAAAUUAUGGAAGUAAUCUU | 3682 |
| AD-1000451.1 | A-1533415.1 | 5893 | gsascuu(Ahd)CfcUfUfUfagaguauugaL96 | A-1249223.1 | 5982 | VPusCfsaaua(Cgn)ucuaaaGfgUfaagucsusu | AAGACUUACCUUUAGAGUAUUGU | 3683 |
| AD-961043.1 | A-1529207.1 | 5894 | csgsgac(Uhd)UfgGfUfUfaccuaucucaL96 | A-1244929.1 | 5983 | VPusGfsagau(Agn)gguaacCfaAfguccgsasc | GUCGGACUUGGUUACCUAUCUCU | 3684 |
| AD-996036.1 | A-1524627.1 | 5895 | asgsuca(Chd)CfaCfUfCfagcauucguaL96 | A-1240189.1 | 5984 | VPusAfscgaa(Tgn)gcugagUfgGfugacusgsa | UCAGUCACCACUCAGCAUUCGUG | 3685 |
| AD-961042.1 | A-1529091.1 | 5896 | ususgcc(Chd)UfuAfUfGfaauguuaguaL96 | A-1244801.1 | 5985 | VPusAfscuaa(Cgn)auucauAfaGfggcaasasa | UUUUGCCCUUAUGAAUGUUAGUC | 3686 |
| AD-1000133.1 | A-1532757.1 | 5897 | csusuuu(Chd)AfcAfGfGfauuguaauuaL96 | A-1248565.1 | 5986 | VPusAfsauua(Cgn)aauccuGfuGfaaaagsasu | AUCUUUUCACAGGAUUGUAAUUA | 3687 |
| AD-961036.1 | A-1527829.1 | 5898 | gscsuga(Ahd)CfcUfAfUfgaauuccgaaL96 | A-1243511.1 | 5987 | VPusUfscgga(Agn)uucauaGfgUfucagcscsu | AGGCUGAACCUAUGAAUUCCGAU | 3688 |
| AD-995573.1 | A-1523683.1 | 5899 | csusucu(Uhd)AfgCfCfUfuguuuaggcaL96 | A-1239237.1 | 5988 | VPusGfsccua(Agn)acaaggCfuAfagaagsgsc | GCCUUCUUAGCCUUGUUUAGGCU | 3689 |
| AD-997715.1 | A-1527964.1 | 5900 | csusgcc(Ahd)AfgUfUfAfacauagaguaL96 | A-1243647.1 | 5989 | VPusAfscucu(Agn)uguuaaCfuUfggcagscsa | UGCUGCCAAGUUAACAUAGAGUC | 3690 |
| AD-996533.1 | A-1525638.1 | 5901 | usgsuag(Ahd)UfcUfUfGfcaauuaccaaL96 | A-1241253.1 | 5990 | VPusUfsggua(Agn)uugcaaGfaUfcuacasasa | UUUGUAGAUCUUGCAAUUACCAU | 3691 |
| AD-995587.1 | A-1523713.1 | 5902 | usasggc(Uhd)AfaUfGfAfcccaagauuaL96 | A-1239267.1 | 5991 | VPusAfsaucu(Tgn)gggucaUfuAfgccuasasa | UUUAGGCUAAUGACCCAAGAUUA | 3692 |
| AD-995660.1 | A-1523863.1 | 5903 | ususugu(Chd)GfuAfGfUfgauuuuccuaL96 | A-1239425.1 | 5992 | VPusAfsggaa(Agn)aucacuAfcGfacaaasgsa | UCUUUGUCGUAGUGAUUUUCCUG | 3693 |
| AD-994670.1 | A-1521918.1 | 5904 | ususgca(Ahd)GfcCfUfCfuuaugugagaL96 | A-1237413.1 | 5993 | VPusCfsucac(Agn)uaagagGfcUfugcaascsc | GGUUGCAAGCCUCUUAUGUGAGG | 3694 |

TABLE 6B

Exemplary Human SCN9A Unmodified Single Strands and Duplex Sequences. Column 1 indicates duplex name and the number following the decimal point in a duplex name merely refers to a batch production number. Column 2 indicates the sense sequence name. Column 3 indicates the sequence ID for the sequence of column 4. Column 4 provides the unmodified sequence of a sense strand suitable for use in a duplex described herein. Column 5 provides the position in the target mRNA (NM_001365536.1) of the sense strand of Column 4. Column 6 indicates the antisense sequence name. Column 7 indicates the sequence ID for the sequence of column 8. Column 8 provides the sequence of an antisense strand suitable for use in a duplex described herein, without specifying chemical modifications. Column 9 indicates the position in the target mRNA (NM_001365536.1) that is complementary to the antisense strand of Column 8.

| Duplex Name | Sense sequence name | Seq ID NO: (sense) | Sense sequence (5'-3') | mRNA target range in NM_001365536.1 | Anti sense sequence name | Seq ID NO: (anti sense) | antisense sequence (5'-3') | mRNA target range in NM_001365536.1 |
|---|---|---|---|---|---|---|---|---|
| AD-996318.1 | A-1525247.1 | 5994 | GGCGUUGUAGUUCCUAUCUCA | 2301-2321 | A-1240821.1 | 2950 | UGAGAUAGGAACUACAACGCCUU | 2299-2321 |
| AD-995116.1 | A-1522818.1 | 5995 | UUCUGUGUAGGAGAAUUCACA | 824-844 | A-1238317.1 | 2951 | UGUGAAUUCUCCUACACAGAAGC | 822-844 |
| AD-995486.1 | A-1523509.1 | 2863 | UGGUUUCAGCACAGAUUCAGA | 1243-1263 | A-1239063.1 | 2952 | UCUGAATCUGUGCUGAAACCACA | 1241-1263 |
| AD-995121.1 | A-1522828.1 | 2864 | UGUAGGAGAAUUCACUUUUCA | 829-849 | A-1238327.1 | 2953 | UGAAAAGUGAAUUCUCCUACACA | 827-849 |
| AD-961022.1 | A-1525636.1 | 2865 | UUUGUAGAUCUUGCAAUUACA | 2531-2551 | A-1241249.1 | 2954 | UGUAAUTGCAAGAUCUACAAAAG | 2529-2551 |
| AD-1002051.1 | A-1536779.1 | 2866 | GUUUGAACACAAAUCUUUCGA | 9174-9194 | A-1252583.1 | 2955 | UCGAAAGAUUUGUGUUCAAACCU | 9172-9194 |
| AD-995873.1 | A-1524297.1 | 2867 | CUUCUGAAACAUCCAAACUGA | 1683-1703 | A-1239861.1 | 2956 | UCAGUUTGGAUGUUUCAGAAGAA | 1681-1703 |
| AD-961040.1 | A-1529029.1 | 2868 | AGUCAAGUUCCAAAUCGUUCA | 4382-4402 | A-1244745.1 | 2957 | UGAACGAUUUGGAACUUGACUUG | 4380-4402 |
| AD-961013.1 | A-1523849.1 | 2869 | GAUCUUCUUUGUCGUAGUGAA | 1435-1455 | A-1239411.1 | 2958 | UUCACUACGACAAAGAAGAUCAU | 1433-1455 |
| AD-995055.1 | A-1522697.1 | 2870 | UGUCGAGUACACUUUUACUGA | 760-780 | A-1238195.1 | 2959 | UCAGUAAAAGUGUACUCGACAUU | 758-780 |
| AD-961010.1 | A-1523843.1 | 2871 | CAUGAUCUUCUUUGUCGUAGA | 1432-1452 | A-1239405.1 | 2960 | UCUACGACAAAGAAGAUCAUGUA | 1430-1452 |
| AD-961000.1 | A-1522351.1 | 2872 | AAGGGAAAACAAUCUUCCGUA | 576-596 | A-1237849.1 | 2961 | UACGGAAGAUUGUUUUCCCUUUG | 574-596 |
| AD-999598.1 | A-1531657.1 | 2873 | AGAUGGAUUCUCUUCGUUCAA | 5862-5882 | A-1247453.1 | 2962 | UUGAACGAAGAGAAUCCAUCUCC | 5860-5882 |
| AD-1002101.1 | A-1536879.1 | 2874 | UGAUAGUUACCUAGUUUGCAA | 9226-9246 | A-1252683.1 | 2963 | UUGCAAACUAGGUAACUAUCAAA | 9224-9246 |
| AD-1001246.1 | A-1535071.1 | 2875 | UAUAUUUUACAACAUCCGUUA | 8022-8042 | A-1250879.1 | 2964 | UAACGGAUGUUGUAAAAUAUAUC | 8020-8042 |
| AD-996618.1 | A-1525802.1 | 2876 | UUGCUAUAGGAAAUUUGGUCA | 2625-2645 | A-1241423.1 | 2965 | UGACCAAAUUUCCUAUAGCAAGU | 2623-2645 |
| AD-961014.1 | A-1523851.1 | 2877 | AUCUUCUUUGUCGUAGUGAUA | 1436-1456 | A-1239413.1 | 2966 | UAUCACTACGACAAAGAAGAUCA | 1434-1456 |
| AD-1000046.1 | A-1532577.1 | 2878 | AUCGUAAGAGAACUCUGUAGA | 6462-6482 | A-1248385.1 | 2967 | UCUACAGAGUUCUCUUACGAUUC | 6460-6482 |
| AD-996319.1 | A-1525249.1 | 2879 | GCGUUGUAGUUCCUAUCUCCA | 2302-2322 | A-1240823.1 | 2968 | UGGAGATAGGAACUACAACGCCU | 2300-2322 |
| AD-961011.1 | A-1523845.1 | 2880 | AUGAUCUUCUUUGUCGUAGUA | 1433-1453 | A-1239407.1 | 2969 | UACUACGACAAAGAAGAUCAUGU | 1431-1453 |
| AD-1002409.1 | A-1537499.1 | 2881 | GCUGUUUACAUAGGAUUCUUA | 9600-9620 | A-1253305.1 | 2970 | UAAGAAUCCUAUGUAAACAGCUU | 9598-9620 |

TABLE 6B-continued

Exemplary Human SCN9A Unmodified Single Strands and Duplex Sequences. Column 1 indicates duplex name and the number following the decimal point in a duplex name merely refers to a batch production number. Column 2 indicates the sense sequence name. Column 3 indicates the sequence ID for the sequence of column 4. Column 4 provides the unmodified sequence of a sense strand suitable for use in a duplex described herein. Column 5 provides the position in the target mRNA (NM_001365536.1) of the sense strand of Column 4. Column 6 indicates the antisense sequence name. Column 7 indicates the sequence ID for the sequence of column 8. Column 8 provides the sequence of an antisense strand suitable for use in a duplex described herein, without specifying chemical modifications. Column 9 indicates the position in the target mRNA (NM_001365536.1) that is complementary to the antisense strand of Column 8.

| Duplex Name | Sense sequence name | Seq ID NO: (sense) | Sense sequence (5'-3') | mRNA target range in NM_001365536.1 | Anti sense sequence name | Seq ID NO: (anti sense) | antisense sequence (5'-3') | mRNA target range in NM_001365536.1 |
|---|---|---|---|---|---|---|---|---|
| AD-1000916.1 | A-1534385.1 | 2882 | CACCUUCUCCUUAAAAUUCUA | 7527-7547 | A-1250193.1 | 2971 | UAGAAUTUUAAGGAGAAGGUGAC | 7525-7547 |
| AD-996733.1 | A-1526036.1 | 2883 | UUGUGACUUUAAGUUUAGUGA | 2742-2762 | A-1241657.1 | 2972 | UCACUAAACUUAAAGUCACAAUA | 2740-2762 |
| AD-961137.1 | A-1535225.1 | 2884 | UCUUUAUACCAUCUUAGGUUA | 8099-8119 | A-1251033.1 | 2973 | UAACCUAAGAUGGUAUAAAGAAU | 8097-8119 |
| AD-961057.1 | A-1531655.1 | 2885 | GAGAUGGAUUCUCUUCGUUCA | 5861-5881 | A-1247451.1 | 2974 | UGAACGAAGAGAAUCCAUCUCCC | 5859-5881 |
| AD-1002100.1 | A-1536877.1 | 2886 | UUGAUAGUUACCUAGUUUGCA | 9225-9245 | A-1252681.1 | 2975 | UGCAAACUAGGUAACUAUCAAAA | 9223-9245 |
| AD-999762.1 | A-1531997.1 | 2887 | GACAGAGAUGAUGAUUUACUA | 6059-6079 | A-1247805.1 | 2976 | UAGUAAAUCAUCAUCUCUGUCUC | 6057-6079 |
| AD-961085.1 | A-1533099.1 | 2888 | AUGUACAGAGGUUAUUCUAUA | 6778-6798 | A-1248907.1 | 2977 | UAUAGAAUAACCUCUGUACAUUG | 6776-6798 |
| AD-961049.1 | A-1530270.1 | 2889 | AUGUUUCUAGCUGAUUUGAUA | 5075-5095 | A-1246031.1 | 2978 | UAUCAAAUCAGCUAGAAACAUAC | 5073-5095 |
| AD-961155.1 | A-1535805.1 | 2890 | CAACACAAUUUCUUCUUAGCA | 8498-8518 | A-1251613.1 | 2979 | UGCUAAGAAGAAAUUGUGUUGUU | 8496-8518 |
| AD-961039.1 | A-1529023.1 | 2891 | GCAAGUCAAGUUCCAAAUCGA | 4379-4399 | A-1244739.1 | 2980 | UCGAUUTGGAACUUGACUUGCAG | 4377-4399 |
| AD-998346.1 | A-1529197.1 | 2892 | AAUGUCGGACUUGGUUACCUA | 4469-4489 | A-1244919.1 | 2981 | UAGGUAACCAAGUCCGACAUUAU | 4467-4489 |
| AD-961056.1 | A-1530988.1 | 2893 | CAUCUGUUGGAAUAUUCUACA | 5496-5516 | A-1246759.1 | 2982 | UGUAGAAUAUUCCAACAGAUGGG | 5494-5516 |
| AD-999259.1 | A-1531002.1 | 2894 | UGGAAUAUUCUACUUUGUUAA | 5503-5523 | A-1246773.1 | 2983 | UUAACAAAGUAGAAUAUUCCAAC | 5501-5523 |
| AD-961093.1 | A-1533709.1 | 2895 | CUGAUAAUAGUCUCUUAAACA | 7151-7171 | A-1249517.1 | 2984 | UGUUUAAGAGACUAUUAUCAGUA | 7149-7171 |
| AD-995521.1 | A-1523579.1 | 2896 | UUGGCAGAAACCCUGAUUAUA | 1296-1316 | A-1239133.1 | 2985 | UAUAAUCAGGGUUUCUGCCAAUU | 1294-1316 |
| AD-997386.1 | A-1527312.1 | 2897 | GCAAAGGUCACAAUUUCCUCA | 3438-3458 | A-1242983.1 | 2986 | UGAGGAAAUUGUGACCUUUGCUC | 3436-3458 |
| AD-961037.1 | A-1527831.1 | 2898 | CUGAACCUAUGAAUUCCGAUA | 3726-3746 | A-1243513.1 | 2987 | UAUCGGAAUUCAUAGGUUCAGCC | 3724-3746 |
| AD-961058.1 | A-1531697.1 | 2899 | GGAAGAAAGGUUCAUGUCUGA | 5887-5907 | A-1247503.1 | 2988 | UCAGACAUGAACCUUUCUUCCAU | 5885-5907 |
| AD-961146.1 | A-1535441.1 | 2900 | AGCCUGUUGGAAAUAGGUUUA | 8219-8239 | A-1251249.1 | 2989 | UAAACCTAUUUCCAACAGGCUUG | 8217-8239 |
| AD-1000747.1 | A-1534041.1 | 2901 | UUAUUGCAUCACUUGUAUACA | 7317-7337 | A-1249849.1 | 2990 | UGUAUACAAGUGAUGCAAUAAAU | 7315-7337 |

TABLE 6B-continued

Exemplary Human SCN9A Unmodified Single Strands and Duplex Sequences. Column 1 indicates duplex name and the number following the decimal point in a duplex name merely refers to a batch production number. Column 2 indicates the sense sequence name. Column 3 indicates the sequence ID for the sequence of column 4. Column 4 provides the unmodified sequence of a sense strand suitable for use in a duplex described herein. Column 5 provides the position in the target mRNA (NM_001365536.1) of the sense strand of Column 4. Column 6 indicates the antisense sequence name. Column 7 indicates the sequence ID for the sequence of column 8. Column 8 provides the sequence of an antisense strand suitable for use in a duplex described herein, without specifying chemical modifications. Column 9 indicates the position in the target mRNA (NM_001365536.1) that is complementary to the antisense strand of Column 8.

| Duplex Name | Sense sequence name | Seq ID NO: (sense) | Sense sequence (5'-3') | mRNA target range in NM_001365536.1 | Anti sense sequence name | Seq ID NO: (anti sense) | antisense sequence (5'-3') | mRNA target range in NM_001365536.1 |
|---|---|---|---|---|---|---|---|---|
| AD-1001409.1 | A-1535447.1 | 2902 | CUGUUGGAAAUAGGUUUUGAA | 8222-8242 | A-1251255.1 | 2991 | UUCAAAACCUAUUUCCAACAGGC | 8220-8242 |
| AD-996130.1 | A-1524811.1 | 2903 | AUCUGAGACUGAAUUUGCCGA | 1993-2013 | A-1240377.1 | 2992 | UCGGCAAAUUCAGUCUCAGAUCC | 1991-2013 |
| AD-999715.1 | A-1531895.1 | 2904 | AGCGUGCUUAUAGACGUUACA | 5988-6008 | A-1247701.1 | 2993 | UGUAACGUCUAUAAGCACGCUGA | 5986-6008 |
| AD-1000678.1 | A-1533901.1 | 2905 | CCUUCCUGAUAUGCAGUUAGA | 7247-7267 | A-1249709.1 | 2994 | UCUAACTGCAUAUCAGGAAGGAU | 7245-7267 |
| AD-1000106.1 | A-1532699.1 | 2906 | GUAGAAAACUUUUACAUCUGA | 6547-6567 | A-1248507.1 | 2995 | UCAGAUGUAAAAGUUUUCUACAU | 6545-6567 |
| AD-1000585.1 | A-1533689.1 | 2907 | GCCCAAAAUACUGAUAAUAGA | 7141-7161 | A-1249497.1 | 2996 | UCUAUUAUCAGUAUUUUGGGCAG | 7139-7161 |
| AD-996635.1 | A-1525836.1 | 2908 | GUCUUUACUGGAAUCUUUGCA | 2642-2662 | A-1241457.1 | 2997 | UGCAAAGAUUCCAGUAAAGACCA | 2640-2662 |
| AD-961163.1 | A-1536023.1 | 2909 | AGCUUGAAGUAAAAUUAGACA | 8687-8707 | A-1251831.1 | 2998 | UGUCUAAUUUUACUUCAAGCUUA | 8685-8707 |
| AD-999601.1 | A-1531663.1 | 2910 | UGGAUUCUCUUCGUUCACAGA | 5865-5885 | A-1247459.1 | 2999 | UCUGUGAACGAAGAGAAUCCAUC | 5863-5885 |
| AD-998015.1 | A-1528540.1 | 2911 | UUUAGUGGCAAACACUCUUGA | 4114-4134 | A-1244249.1 | 3000 | UCAAGAGUGUUUGCCACUAAAGU | 4112-4134 |
| AD-961009.1 | A-1523841.1 | 2912 | ACAUGAUCUUCUUUGUCGUAA | 1431-1451 | A-1239403.1 | 3001 | UUACGACAAAGAAGAUCAUGUAG | 1429-1451 |
| AD-961078.1 | A-1532751.1 | 2913 | CAUCUUUUCACAGGAUUGUAA | 6573-6593 | A-1248559.1 | 3002 | UUACAAUCCUGUGAAAAGAUGAC | 6571-6593 |
| AD-999986.1 | A-1532445.1 | 2914 | CUGAUUUCCUAAGAAAGGUGA | 6396-6416 | A-1248253.1 | 3003 | UCACCUUCUUAGGAAAUCAGAG | 6394-6416 |
| AD-961138.1 | A-1535227.1 | 2915 | CUUUAUACCAUCUUAGGUUCA | 8100-8120 | A-1251035.1 | 3004 | UGAACCTAAGAUGGUAUAAAGAA | 8098-8120 |
| AD-961066.1 | A-1531899.1 | 2916 | CGUGCUUAUAGACGUUACCGA | 5990-6010 | A-1247705.1 | 3005 | UCGGUAACGUCUAUAAGCACGCU | 5988-6010 |
| AD-998261.1 | A-1529027.1 | 2917 | AAGUCAAGUUCCAAAUCGUUA | 4381-4401 | A-1244743.1 | 3006 | UAACGAUUUGGAACUUGACUUGC | 4379-4401 |
| AD-995823.1 | A-1524195.1 | 2918 | CUGAAUAUACAAGUAUUAGGA | 1632-1652 | A-1239759.1 | 3007 | UCCUAATACUUGUAUAUUCAGCC | 1630-1652 |
| AD-996052.1 | A-1524655.1 | 2919 | UCGUGGCUCCUUGUUUUCUGA | 1915-1935 | A-1240221.1 | 3008 | UCAGAAAACAAGGAGCCACGAAU | 1913-1935 |
| AD-999721.1 | A-1531917.1 | 2920 | AGACGUUACCGCUUAAGGCAA | 5999-6019 | A-1247723.1 | 3009 | UUGCCUTAAGCGGUAACGUCUAU | 5997-6019 |
| AD-1000130.1 | A-1532749.1 | 2921 | UCAUCUUUUCACAGGAUUGUA | 6572-6592 | A-1248557.1 | 3010 | UACAAUCCUGUGAAAAGAUGACA | 6570-6592 |

TABLE 6B-continued

Exemplary Human SCN9A Unmodified Single Strands and Duplex Sequences. Column 1 indicates duplex name and the number following the decimal point in a duplex name merely refers to a batch production number. Column 2 indicates the sense sequence name. Column 3 indicates the sequence ID for the sequence of column 4. Column 4 provides the unmodified sequence of a sense strand suitable for use in a duplex described herein. Column 5 provides the position in the target mRNA (NM_001365536.1) of the sense strand of Column 4. Column 6 indicates the antisense sequence name. Column 7 indicates the sequence ID for the sequence of column 8. Column 8 provides the sequence of an antisense strand suitable for use in a duplex described herein, without specifying chemical modifications. Column 9 indicates the position in the target mRNA (NM_001365536.1) that is complementary to the antisense strand of Column 8.

| Duplex Name | Sense sequence name | Seq ID NO: (sense) | Sense sequence (5'-3') | mRNA target range in NM_001365536.1 | Anti sense sequence name | Seq ID NO: (anti sense) | antisense sequence (5'-3') | mRNA target range in NM_001365536.1 |
|---|---|---|---|---|---|---|---|---|
| AD-1000115.1 | A-1532717.1 | 2922 | UUUUACAUCUGCCUUGUCAUA | 6556-6576 | A-1248525.1 | 3011 | UAUGACAAGGCAGAUGUAAAAGU | 6554-6576 |
| AD-961106.1 | A-1533903.1 | 2923 | CUUCCUGAUAUGCAGUUAGUA | 7248-7268 | A-1249711.1 | 3012 | UACUAACUGCAUAUCAGGAAGGA | 7246-7268 |
| AD-995824.1 | A-1524197.1 | 2924 | UGAAUAUACAAGUAUUAGGAA | 1633-1653 | A-1239761.1 | 3013 | UUCCUAAUACUUGUAUAUUCAGC | 1631-1653 |
| AD-998897.1 | A-1530274.1 | 2925 | GUUUCUAGCUGAUUUGAUUGA | 5077-5097 | A-1246035.1 | 3014 | UCAAUCAAAUCAGCUAGAAACAU | 5075-5097 |
| AD-999348.1 | A-1531160.1 | 2926 | UGCCACUGAAGAAAGUACUGA | 5593-5613 | A-1246951.1 | 3015 | UCAGUACUUUCUUCAGUGGCAAC | 5591-5613 |
| AD-961012.1 | A-1523847.1 | 2927 | UGAUCUUCUUUGUCGUAGUGA | 1434-1454 | A-1239409.1 | 3016 | UCACUACGACAAAGAAGAUCAUG | 1432-1454 |
| AD-999215.1 | A-1530912.1 | 2928 | UCAUCCUGGAAGUUCAGUUGA | 5458-5478 | A-1246683.1 | 3017 | UCAACUGAACUUCCAGGAUGAAC | 5456-5478 |
| AD-961044.1 | A-1529794.1 | 2929 | AUGUAUAUUUGACCUAGUGAA | 4816-4836 | A-1245553.1 | 3018 | UUCACUAGGUCAAAUAUACAUCC | 4814-4836 |
| AD-961004.1 | A-1522695.1 | 2930 | AUGUCGAGUACACUUUUACUA | 759-779 | A-1238193.1 | 3019 | UAGUAAAAGUGUACUCGACAUUU | 757-779 |
| AD-961024.1 | A-1526032.1 | 2931 | UAUUGUGACUUUAAGUUUAGA | 2740-2760 | A-1241653.1 | 3020 | UCUAAACUUAAAGUCACAAUAAG | 2738-2760 |
| AD-998894.1 | A-1530266.1 | 2932 | GUAUGUUUCUAGCUGAUUUGA | 5073-5093 | A-1246027.1 | 3021 | UCAAAUCAGCUAGAAACAUACCU | 5071-5093 |
| AD-999596.1 | A-1531651.1 | 2933 | GGGAGAUGGAUUCUCUUCGUA | 5859-5879 | A-1247447.1 | 3022 | UACGAAGAGAAUCCAUCUCCCCA | 5857-5879 |
| AD-1000679.1 | A-1533905.1 | 2934 | UUCCUGAUAUGCAGUUAGUUA | 7249-7269 | A-1249713.1 | 3023 | UAACUAACUGCAUAUCAGGAAGG | 7247-7269 |
| AD-1000864.1 | A-1534279.1 | 2935 | CAACUUACUUUCCUAAAUUAA | 7456-7476 | A-1250087.1 | 3024 | UUAAUUTAGGAAAGUAAGUUGGU | 7454-7476 |
| AD-996619.1 | A-1525804.1 | 2936 | UGCUAUAGGAAAUUUGGUCUA | 2626-2646 | A-1241425.1 | 3025 | UAGACCAAAUUUCCUAUAGCAAG | 2624-2646 |
| AD-961109.1 | A-1534303.1 | 2937 | CUAAAUUAUGGAAGUAAUCUA | 7468-7488 | A-1250111.1 | 3026 | UAGAUUACUUCCAUAAUUUAGGA | 7466-7488 |
| AD-1000451.1 | A-1533415.1 | 2938 | GACUUACCUUUAGAGUAUUGA | 6944-6964 | A-1249223.1 | 3027 | UCAAUACUCUAAAGGUAAGUCUU | 6942-6964 |
| AD-961043.1 | A-1529207.1 | 2939 | CGGACUUGGUUACCUAUCUCA | 4474-4494 | A-1244929.1 | 3028 | UGAGAUAGGUAACCAAGUCCGAC | 4472-4494 |
| AD-996036.1 | A-1524627.1 | 2940 | AGUCACCACUCAGCAUUCGUA | 1899-1919 | A-1240189.1 | 3029 | UACGAATGCUGAGUGGUGACUGA | 1897-1919 |
| AD-961042.1 | A-1529091.1 | 2941 | UUGCCCUUAUGAAUGUUAGUA | 4410-4430 | A-1244801.1 | 3030 | UACUAACAUUCAUAAGGGCAAAA | 4408-4430 |

TABLE 6B-continued

Exemplary Human SCN9A Unmodified Single Strands and Duplex Sequences. Column 1 indicates duplex name and the number following the decimal point in a duplex name merely refers to a batch production number. Column 2 indicates the sense sequence name. Column 3 indicates the sequence ID for the sequence of column 4. Column 4 provides the unmodified sequence of a sense strand suitable for use in a duplex described herein. Column 5 provides the position in the target mRNA (NM_001365536.1) of the sense strand of Column 4. Column 6 indicates the antisense sequence name. Column 7 indicates the sequence ID for the sequence of column 8. Column 8 provides the sequence of an antisense strand suitable for use in a duplex described herein, without specifying chemical modifications. Column 9 indicates the position in the target mRNA (NM 001365536.1) that is complementary to the antisense strand of Column 8.

| Duplex Name | Sense sequence name | Seq ID NO: (sense) | Sense sequence (5'-3') | mRNA target range in NM_001365536.1 | Anti sense sequence name | Seq ID NO: (anti sense) | antisense sequence (5'-3') | mRNA target range in NM_001365536.1 |
|---|---|---|---|---|---|---|---|---|
| AD-1000133.1 | A-1532757.1 | 2942 | CUUUUCACAGGAUUGUAAUUA | 6576-6596 | A-1248565.1 | 3031 | UAAUUACAAUCCUGUGAAAAGAU | 6574-6596 |
| AD-961036.1 | A-1527829.1 | 2943 | GCUGAACCUAUGAAUUCCGAA | 3725-3745 | A-1243511.1 | 3032 | UUCGGAAUUCAUAGGUUCAGCCU | 3723-3745 |
| AD-995573.1 | A-1523683.1 | 2944 | CUUCUUAGCCUUGUUUAGGCA | 1348-1368 | A-1239237.1 | 3033 | UGCCUAAACAAGGCUAAGAAGGC | 1346-1368 |
| AD-997715.1 | A-1527964.1 | 2945 | CUGCCAAGUUAACAUAGAGUA | 3793-3813 | A-1243647.1 | 3034 | UACUCUAUGUUAACUUGGCAGCA | 3791-3813 |
| AD-996533.1 | A-1525638.1 | 2946 | UGUAGAUCUUGCAAUUACCAA | 2533-2553 | A-1241253.1 | 3035 | UUGGUAAUUGCAAGAUCUACAAA | 2531-2553 |
| AD-995587.1 | A-1523713.1 | 2947 | UAGGCUAAUGACCCAAGAUUA | 1363-1383 | A-1239267.1 | 3036 | UAAUCUTGGGUCAUUAGCCUAAA | 1361-1383 |
| AD-995660.1 | A-1523863.1 | 2948 | UUUGUCGUAGUGAUUUUCCUA | 1442-1462 | A-1239425.1 | 3037 | UAGGAAAAUCACUACGACAAAGA | 1440-1462 |
| AD-994670.1 | A-1521918.1 | 2949 | UUGCAAGCCUCUUAUGUGAGA | 243-263 | A-1237413.1 | 3038 | UCUCACAUAAGAGGCUUGCAACC | 241-263 |

TABLE 13A

Exemplary Human SCN9A siRNA Modified Single Strands and Duplex Sequences Column 1 indicates duplex name and the number following the decimal point in a duplex name merely refers to a batch production number. Column 2 indicates the name of the sense sequence. Column 3 indicates the sequence ID for the sequence of column 4. Column 4 provides the modified sequence of a sense strand suitable for use in a duplex described herein. Column 5 indicates the antisense sequence name. Column 6 indicates the sequence ID for the sequence of column 7. Column 7 provides the sequence of a modified antisense strand suitable for use in a duplex described herein, e.g., a duplex comprising the sense sequence in the same row of the table. Column 8 indicates the position in the target mRNA (NM_001365536.1) that is complementary to the antisense strand of Column 7. Column 9 indicated the sequence ID for the sequence of column 8.

| Duplex Name | Sense sequence name | Seq ID NO: (sense) | Sense sequence (5'-3') | Antisense sequence name | Seq ID NO: (anti sense) | Antisense sequence (5'-3') | mRNA target sequence in NM_001365536.1 | SEQ ID NO: (mRNA target) |
|---|---|---|---|---|---|---|---|---|
| AD-1251302.1 | A-2337487.1 | 4000 | ascsacaaagdGgdAaaa(Chd)aaucuaL96 | A-2337488.1 | 4266 | VPusAfsgadTu(G2p)uuuudCcCfuUfugugususc | | |
| AD-1251303.1 | A-2337489.1 | 5802 | csascaaagggAfAfaacaa(Uhd)cuuaL96 | A-2337490.1 | 4267 | VPusAfsagdAudTguuuucCfcUfuugugsusu | | |
| AD-1251304.1 | A-2337491.1 | 5803 | ascsaaagggAfAfAfacaa(Uhd)cuucaL96 | A-2337492.1 | 4268 | VPudGaadGadTuguuuuCfcCfuuugusgsu | GAACAAAGGGAAAACAAUCUUCC | 4534 |

TABLE 13A-continued

Exemplary Human SCN9A siRNA Modified Single Strands and Duplex Sequences Column 1 indicates duplex name and the number following the decimal point in a duplex name merely refers to a batch production number. Column 2 indicates the name of the sense sequence. Column 3 indicates the sequence ID for the sequence of column 4. Column 4 provides the modified sequence of a sense strand suitable for use in a duplex described herein. Column 5 indicates the antisense sequence name. Column 6 indicates the sequence ID for the sequence of column 7. Column 7 provides the sequence of a modified antisense strand suitable for use in a duplex described herein, e.g., a duplex comprising the sense sequence in the same row of the table. Column 8 indicates the position in the target mRNA (NM_001365536.1) that is complementary to the antisense strand of Column 7. Column 9 indicated the sequence ID for the sequence of column 8.

| Duplex Name | Sense sequence name | Seq ID NO: (sense) | Sense sequence (5'-3') | Antisense sequence name | Seq ID NO: (anti sense) | Antisense sequence (5'-3') | mRNA target sequence in NM_00136 5536.1 | SEQ ID NO: (mRNA target) |
|---|---|---|---|---|---|---|---|---|
| AD-1251305.1 | A-2337493.1 | 4003 | csasaagggaAfAfAfcaau(Chd)uuccaL96 | A-2337494.1 | 4269 | VPudGgadAgdAuuguuuUfcCfcuuugsusg | AACAAAGGGAAAACAAUCUUCCG | 4535 |
| AD-1251306.1 | A-2337495.1 | 4004 | asasagggAfaAfAfCfaauc(Uhd)uccgaL96 | A-2337496.1 | 4270 | VPusCfsggdAadGauuguuUfuCfccuuusgsu | ACAAAGGGAAAACAAUCUUCCGU | 4536 |
| AD-1251307.1 | A-2337497.1 | 4005 | asasagggaadAaCfaauc(Uhd)uccgaL96 | A-2337498.1 | 4271 | VPuCfggdAadGauugdTuUfuCfccuuusgsu | ACAAAGGGAAAACAAUCUUCCGU | 4537 |
| AD-1251315.1 | A-2337506.1 | 4006 | asasgggaaaAfCfAfaucu(Uhd)ccguaL96 | A-2337501.1 | 4272 | VPusdAscgdGa(A2p)gauudGuUfudTcccuususg | CAAAGGGAAAACAAUCUUCCGUU | 4538 |
| AD-1251310.1 | A-2337499.1 | 4007 | asasgggaaadAcdAaucu(Uhd)ccguaL96 | A-2337501.1 | 4273 | VPusdAscgdGa(A2p)gauudGuUfudTcccuususg | CAAAGGGAAAACAAUCUUCCGUU | 4539 |
| AD-961179.3 | A-1812594.1 | 4008 | asasggg(Ahd)aadAcdAaucuuccguaL96 | A-1812595.1 | 4274 | VPusdAscgdGadAgauudGudTudTcccuususg | CAAAGGGAAAACAAUCUUCCGUU | 4540 |
| AD-1251308.1 | A-2337499.1 | 4009 | asasgggaaadAcdAaucu(Uhd)ccguaL96 | A-1812595.1 | 4275 | VPusdAscgdGadAgauudGudTudTcccuususg | CAAAGGGAAAACAAUCUUCCGUU | 4541 |
| AD-1251314.1 | A-2337506.1 | 4010 | asasgggaaaAfCfAfaucu(Uhd)ccguaL96 | A-2337500.1 | 4276 | VPusdAscgdGa(Agn)gauudGuUfudTcccuususg | CAAAGGGAAAACAAUCUUCCGUU | 4542 |
| AD-1251309.2 | A-2337499.1 | 4011 | asasgggaaadAcdAaucu(Uhd)ccguaL96 | A-2337500.1 | 4277 | VPusdAscgdGa(Agn)gauudGuUfudTcccuususg | CAAAGGGAAAACAAUCUUCCGUU | 4543 |
| AD-1251316.1 | A-2337506.1 | 4012 | asasgggaaaAfCfAfaucu(Uhd)ccguaL96 | A-2337507.1 | 4278 | VPudAcgdGa(Agn)gauudGuUfudTcccuususg | CAAAGGGAAAACAAUCUUCCGUU | 4544 |
| AD-1251317.1 | A-2337506.1 | 4013 | asasgggaaaAfCfAfaucu(Uhd)ccguaL96 | A-2337508.1 | 4279 | VPudAcgdGa(A2p)gauudGuUfudTcccuususg | CAAAGGGAAAACAAUCUUCCGUU | 4545 |
| AD-1251311.1 | A-2337499.1 | 4014 | asasgggaaadAcdAaucu(Uhd)ccguaL96 | A-2337502.1 | 4280 | VPusdAscgdGa(A2p)gauudGuUfudTcccuscsc | CAAAGGGAAAACAAUCUUCCGUU | 4546 |
| AD-1251309.1 | A-2337499.1 | 4015 | asasgggaaadAcdAaucu(Uhd)ccguaL96 | A-2337500.1 | 4281 | VPusdAscgdGa(Agn)gauudGuUfudTcccuususg | CAAAGGGAAAACAAUCUUCCGUU | 4547 |
| AD-1251318.1 | A-2337509.1 | 4016 | asgsggaaAfaCfAfAfucuu(Chd)cguuaL96 | A-2337510.1 | 4282 | VPusAfsacdGgdAagauugUfuUfucccususu | AAAGGGAAAACAAUCUUCCGUUU | 4548 |
| AD-1251319.1 | A-2337511.1 | 4017 | asgsggaaaaCfadAucuu(Chd)cguuaL96 | A-2337512.1 | 4283 | VPudAacdGgdAagaudTgUfuUfucccususu | AAAGGGAAAACAAUCUUCCGUUU | 4549 |

TABLE 13A-continued

Exemplary Human SCN9A siRNA Modified Single Strands and Duplex Sequences Column 1 indicates duplex name and the number following the decimal point in a duplex name merely refers to a batch production number. Column 2 indicates the name of the sense sequence. Column 3 indicates the sequence ID for the sequence of column 4. Column 4 provides the modified sequence of a sense strand suitable for use in a duplex described herein. Column 5 indicates the antisense sequence name. Column 6 indicates the sequence ID for the sequence of column 7. Column 7 provides the sequence of a modified antisense strand suitable for use in a duplex described herein, e.g., a duplex comprising the sense sequence in the same row of the table. Column 8 indicates the position in the target mRNA (NM_001365536.1) that is complementary to the antisense strand of Column 7. Column 9 indicated the sequence ID for the sequence of column 8.

| Duplex Name | Sense sequence name | Seq ID NO: (sense) | Sense sequence (5'-3') | Antisense sequence name | Seq ID NO: (anti sense) | Antisense sequence (5'-3') | mRNA target sequence in NM_001365536.1 | SEQ ID NO: (mRNA target) |
|---|---|---|---|---|---|---|---|---|
| AD-1251313.1 | A-2337503.1 | 4018 | gsgsgaaadAcdAaucu(Uhd)ccguaL96 | A-2337505.1 | 4284 | VPusdAscgdGa(A2p)gauudGuUfudTcccsuSU | AAGGGAAAACAAUCUUCCGUU | 4550 |
| AD-1251312.1 | A-2337503.1 | 4019 | gsgsgaaadAcdAaucu(Uhd)ccguaL96 | A-2337504.1 | 4285 | VPusdAscgdGa(Agn)gauudGuUfudTcccsusu | AAGGGAAAACAAUCUUCCGUU | 4551 |
| AD-1251320.1 | A-2337513.1 | 4020 | gsgsgaaaAfcAfaUfcuuc(Chd)guuuaL96 | A-2337514.1 | 4286 | VPusAfsaadCgdGaagadTudGuUfuucccsusu | AAGGGAAAACAAUCUUCCGUUUC | 4552 |
| AD-1251321.1 | A-2337515.1 | 4021 | gsgsaaaa(Chd)aaUfCfuuccguuucaL96 | A-2337516.1 | 4287 | VPudGaadAcdGgaagauUfgUfuuuccscsu | AGGGAAAACAAUCUUCCGUUUCA | 4553 |
| AD-1251323.1 | A-2337519.1 | 4022 | gsasaaa(Chd)aaUfCfUfuccguuucaaL96 | A-2337520.1 | 4288 | VPuUfgadAa(C2p)ggaagaUfudGuuuucscsc | GGGAAAACAAUCUUCCGUUUCAA | 4554 |
| AD-1251322.1 | A-2337517.1 | 4023 | gsasaaa(Chd)aaUfCfUfuccauuucaaL96 | A-2337518.1 | 4289 | VPuUfgadAadTggaagaUfudGuuuucscsc | GGGAAAACAAUCUUCCGUUUCAA | 4555 |
| AD-1251325.1 | A-2337523.1 | 4024 | asasaacaauCfUfUfccgu(Uhd)ucaaaL96 | A-2337524.1 | 4290 | VPuUfugdAadAcggadAgdAuUfguuuuscsc | GGAAAACAAUCUUCCGUUUCAAU | 4556 |
| AD-1251324.1 | A-2337521.1 | 4025 | asasaacaAfuCfUfUfccgu(Uhd)ucaaaL96 | A-2337522.1 | 4291 | VPusUfsugdAadAcggaagAfuUfguuuuscsc | GGAAAACAAUCUUCCGUUUCAAU | 4557 |
| AD-1251249.1 | A-2337423.1 | 4026 | usgsucgaguAfCfAfcuuu(Uhd)acugaL96 | A-2337424.1 | 4292 | VPusCfsagdTadAaaguguAfcUfcgacasusu | AAUGUCGAGUACACUUUUACUGG | 4558 |
| AD-1251254.1 | A-2337423.1 | 4027 | usgsucgaguAfCfAfcuuu(Uhd)acugaL96 | A-2337431.1 | 4293 | VPuCfagdTadAaaguguAfcUfcgacascsc | AAUGUCGAGUACACUUUUACUGG | 4559 |
| AD-1251248.1 | A-2337423.1 | 4028 | usgsucgaguAfCfAfcuuu(Uhd)acugaL96 | A-1522698.1 | 4294 | VPusCfsaguAfaAfAfguguAfcUfcgacasusu | AAUGUCGAGUACACUUUUACUGG | 4560 |
| AD-1251284.1 | A-2337423.1 | 4029 | usgsucgaguAfCfAfcuuu(Uhd)acugaL96 | A-2337467.1 | 4295 | VPusCfsagdTadAaagudGuAfcdTcgacasusu | AAUGUCGAGUACACUUUUACUGG | 4561 |
| AD-1251253.1 | A-2337428.1 | 4030 | usgsucgagudAcdAcuuu(Uhd)acugaL96 | A-2337430.1 | 4296 | VPusCfsagdTadAaagudGudAcUfcgacascsc | AAUGUCGAGUACACUUUUACUGG | 4562 |
| AD-1251286.1 | A-2337423.1 | 4031 | usgsucgaguAfCfAfcuuu(Uhd)acugaL96 | A-2337469.1 | 4297 | VPusCfsagdTadAaagudGuAfcdTcgacascsc | AAUGUCGAGUACACUUUUACUGG | 4563 |
| AD-1251282.1 | A-2337423.1 | 4032 | usgsucgaguAfCfAfcuuu(Uhd)acugaL96 | A-1875199.1 | 4298 | VPusdCsagdTadAaagudGudAcdTcgacasusu | AAUGUCGAGUACACUUUUACUGG | 4564 |

TABLE 13A-continued

Exemplary Human SCN9A siRNA Modified Single Strands and Duplex Sequences Column 1 indicates duplex name and the number following the decimal point in a duplex name merely refers to a batch production number. Column 2 indicates the name of the sense sequence. Column 3 indicates the sequence ID for the sequence of column 4. Column 4 provides the modified sequence of a sense strand suitable for use in a duplex described herein. Column 5 indicates the antisense sequence name. Column 6 indicates the sequence ID for the sequence of column 7. Column 7 provides the sequence of a modified antisense strand suitable for use in a duplex described herein, e.g., a duplex comprising the sense sequence in the same row of the table. Column 8 indicates the position in the target mRNA (NM_001365536.1) that is complementary to the antisense strand of Column 7. Column 9 indicated the sequence ID for the sequence of column 8.

| Duplex Name | Sense sequence name | Seq ID NO: (sense) | Sense sequence (5'-3') | Antisense sequence name | Seq ID NO: (anti sense) | Antisense sequence (5'-3') | mRNA target sequence in NM_001365536.1 | SEQ ID NO: (mRNA target) |
|---|---|---|---|---|---|---|---|---|
| AD-1010661.3 | A-1851664.1 | 4033 | usgsucg(Ahd)gudAcdAcuuuuacugaL96 | A-1875199.1 | 4299 | VPusdCsagdTadAaagudGudAcdTcgacasusu | AAUGUCGAGUACACUUUUACUGG | 4565 |
| AD-795305.3 | A-1522697.1 | 4034 | usgsucg(Ahd)GfuAfCfAfcuuuuacugaL96 | A-1522698.1 | 4300 | VPusCfsaguAfaAfAfguguAfcUfcgacasusu | AAUGUCGAGUACACUUUUACUGG | 4566 |
| AD-1251250.1 | A-2337423.1 | 4035 | usgsucgaguAfCfAfcuuu(Uhd)acugaL96 | A-2337425.1 | 4301 | VPusCfsagdTadAaaguguAfcUfcgacascsc | AAUGUCGAGUACACUUUUACUGG | 4567 |
| AD-1251283.1 | A-2337423.1 | 4036 | usgsucgaguAfCfAfcuuu(Uhd)acugaL96 | A-2337466.1 | 4302 | VPusCfsagdTadAaagudGudAcdTcgacasusu | AAUGUCGAGUACACUUUUACUGG | 4568 |
| AD-1251281.1 | A-2337428.1 | 4037 | usgsucgagudAcdAcuuu(Uhd)acugaL96 | A-2337466.1 | 4303 | VPusCfsagdTadAaagudGudAcdTcgacasusu | AAUGUCGAGUACACUUUUACUGG | 4569 |
| AD-1251255.1 | A-2337428.1 | 4038 | usgsucgagudAcdAcuuu(Uhd)acugaL96 | A-2337432.1 | 4304 | VPuCfagdTadAaagudGudAcUfcgacascsc | AAUGUCGAGUACACUUUUACUGG | 4570 |
| AD-1251289.1 | A-2337428.1 | 4039 | usgsucgagudAcdAcuuu(Uhd)acugaL96 | A-2337473.1 | 4305 | VPuCfagdTadAaagudGudAcdTcgacasusu | AAUGUCGAGUACACUUUUACUGG | 4571 |
| AD-1251252.1 | A-2337428.1 | 4040 | usgsucgagudAcdAcuuu(Uhd)acugaL96 | A-2337429.1 | 4306 | VPusCfsagdTadAaagudGudAcUfcgacasusu | AAUGUCGAGUACACUUUUACUGG | 4572 |
| AD-1251285.1 | A-2337428.1 | 4041 | usgsucgagudAcdAcuuu(Uhd)acugaL96 | A-2337468.1 | 4307 | VPusCfsagdTadAaagudGudAcdTcgacascsc | AAUGUCGAGUACACUUUUACUGG | 4573 |
| AD-1251291.1 | A-2337428.1 | 4042 | usgsucgagudAcdAcuuu(Uhd)acugaL96 | A-2337475.1 | 4308 | VPuCfagdTadAaagudGudAcdTcgacascsc | AAUGUCGAGUACACUUUUACUGG | 4574 |
| AD-1251290.1 | A-2337423.1 | 4043 | usgsucgaguAfCfAfcuuu(Uhd)acugaL96 | A-2337474.1 | 4309 | VPuCfagdTadAaagudGuAfcdTcgacasusu | AAUGUCGAGUACACUUUUACUGG | 4575 |
| AD-1251251.1 | A-2337426.1 | 4044 | uscsgaguAfCfAfcuuu(Uhd)acugaL96 | A-2337427.1 | 4310 | VPusCfsagdTadAaaguguAfcUfcgascsg | UGUCGAGUACACUUUUACUGG | 4576 |
| AD-1251287.1 | A-2337470.1 | 4045 | uscsgagudAcdAcuuu(Uhd)acugaL96 | A-2337471.1 | 4311 | VPusCfsagdTadAaagudGudAcdTcgascsg | UGUCGAGUACACUUUUACUGG | 4577 |
| AD-1251288.1 | A-2337426.1 | 4046 | uscsgaguAfCfAfcuuu(Uhd)acugaL96 | A-2337472.1 | 4312 | VPusCfsagdTadAaagudGuAfcdTcgascsg | UGUCGAGUACACUUUUACUGG | 4578 |
| AD-1251326.1 | A-2337525.1 | 4047 | gsasggc(Uhd)UfcUfgUfguaggagaaaL96 | A-2337526.1 | 4313 | VPuUfucdTc(C2p)uacadCadGaAfgccucsusu | AAGAGGCUUCUGUGUAGGAGAAU | 4579 |

TABLE 13A-continued

Exemplary Human SCN9A siRNA Modified Single Strands and Duplex Sequences
Column 1 indicates duplex name and the number following the decimal point in a duplex name merely refers to a batch production number. Column 2 indicates the name of the sense sequence. Column 3 indicates the sequence ID for the sequence of column 4. Column 4 provides the modified sequence of a sense strand suitable for use in a duplex described herein. Column 5 indicates the antisense sequence name. Column 6 indicates the sequence ID for the sequence of column 7. Column 7 provides the sequence of a modified antisense strand suitable for use in a duplex described herein, e.g., a duplex comprising the sense sequence in the same row of the table. Column 8 indicates the position in the target mRNA (NM_001365536.1) that is complementary to the antisense strand of Column 7. Column 9 indicated the sequence ID for the sequence of column 8.

| Duplex Name | Sense sequence name | Seq ID NO: (sense) | Sense sequence (5'-3') | Antisense sequence name | Seq ID NO: (anti sense) | Antisense sequence (5'-3') | mRNA target sequence in NM_001365536.1 | SEQ ID NO: (mRNA target) |
|---|---|---|---|---|---|---|---|---|
| AD-1251327.1 | A-1851778.1 | 4048 | asgsgcu(Uhd)cudGudGuaggagaaauaL96 | A-2337527.1 | 4314 | VPudAuudCu(C2p)cuacdAcdAgdAagccuscSU | AGAGGCUUCUGUGUAGGAGAAUU | 4580 |
| AD-1251328.1 | A-2337528.1 | 4049 | gsgscuu(Chd)UfgUfgUfaggagaauuaL96 | A-2337529.1 | 4315 | VPudAaudTc(Tgn)ccuadCaCfadGaagccsusc | GAGGCUUCUGUGUAGGAGAAUUC | 4581 |
| AD-1251329.1 | A-2337530.1 | 4050 | gscsuuc(Uhd)gugUfAfggagaauucaL96 | A-2337531.1 | 4316 | VPudGaadTu(C2p)uccuacAfcAfgaagcscsu | AGGCUUCUGUGUAGGAGAAUUCA | 4582 |
| AD-1251330.1 | A-2337532.1 | 4051 | csusucug(Uhd)gdTadGgagaauucaaL96 | A-2337533.1 | 4317 | VPuUfgadAu(Tgn)cuccdTaCfaCfagaagcscc | GGCUUCUGUGUAGGAGAAUUCAC | 4583 |
| AD-795366.3 | A-1522818.1 | 4052 | usuči cug(Uhd)GfuAfGfGfagaauucacaL96 | A-1522819.1 | 4318 | VPusGfsugaAfuUfCfuccuAfcAfcagaasgsc | GCUUCUGUGUAGGAGAAUUCACU | 4584 |
| AD-1251331.1 | A-1522818.1 | 4053 | ususcug(Uhd)GfuAfGfGfagaauucacaL96 | A-2337534.1 | 4319 | VPusGfsugdAa(Tgn)ucuccuAfcAfcagaasgsc | GCUUCUGUGUAGGAGAAUUCACU | 4585 |
| AD-1251334.1 | A-2337536.1 | 4054 | ususcug(Uhd)guAfgdGagaauucacaL96 | A-2337538.1 | 4320 | VPusdGsugdAa(U2p)ucucdCuAfcAfcagaasgsc | GCUUCUGUGUAGGAGAAUUCACU | 4586 |
| AD-1251333.1 | A-2337536.1 | 4055 | ususcug(Uhd)guAfgdGagaauucacaL96 | A-2337537.1 | 4321 | VPusdGsugdAa(Tgn)ucucdCuAfcAfcagaasgsc | GCUUCUGUGUAGGAGAAUUCACU | 4587 |
| AD-1251338.1 | A-1851786.1 | 4056 | ususcug(Uhd)gudAgdGagaauucacaL96 | A-2337542.1 | 4322 | VPudGugdAa(U2p)ucucdCudAcdAcagaasgsc | GCUUCUGUGUAGGAGAAUUCACU | 4588 |
| AD-1251337.1 | A-1851786.1 | 4057 | ususcug(Uhd)gudAgdGagaauucacaL96 | A-2337541.1 | 4323 | VPudGugdAa(Tgn)ucucdCudAcdAcagaasgsc | GCUUCUGUGUAGGAGAAUUCACU | 4589 |
| AD-1251336.1 | A-2337536.1 | 4058 | ususcug(Uhd)guAfgdGagaauucacaL96 | A-2337540.1 | 4324 | VPusdGsugdAa(U2p)ucucdCuAfcAfcagaasusc | GCUUCUGUGUAGGAGAAUUCACU | 4590 |
| AD-1251335.1 | A-2337536.1 | 4059 | ususcug(Uhd)guAfgdGagaauucacaL96 | A-2337539.1 | 4325 | VPusdGsugdAa(Tgn)ucucdCuAfcAfcagaasusc | GCUUCUGUGUAGGAGAAUUCACU | 4591 |
| AD-1251339.1 | A-2337543.1 | 4060 | uscsuguguadGgdAgaau(Uhd)cacuaL96 | A-2337544.1 | 4326 | VPudAgudGa(Agn)uucucdCcUfaCfacagasgsg | CUUCUGUGUAGGAGAAUUCACUU | 4592 |
| AD-1251340.1 | A-1851790.1 | 4061 | csusgug(Uhd)agdGadGaauucacuuaL96 | A-2337545.1 | 4327 | VPudAagdTgdAauucdTcCfudAcacagsgsg | UUCUGUGUAGGAGAAUUCACUUU | 4593 |
| AD-1251341.1 | A-2337546.1 | 4062 | usgsug(Uhd)aggAfgAfauucacuuuaL96 | A-2337547.1 | 4328 | VPudAaadGu(G2p)aauudCuCfcUfacacasgsg | UCUGUGUAGGAGAAUUCACUUUU | 4594 |

TABLE 13A-continued

Exemplary Human SCN9A siRNA Modified Single Strands and Duplex Sequences Column 1 indicates duplex name and the number following the decimal point in a duplex name merely refers to a batch production number. Column 2 indicates the name of the sense sequence. Column 3 indicates the sequence ID for the sequence of column 4. Column 4 provides the modified sequence of a sense strand suitable for use in a duplex described herein. Column 5 indicates the antisense sequence name. Column 6 indicates the sequence ID for the sequence of column 7. Column 7 provides the sequence of a modified antisense strand suitable for use in a duplex described herein, e.g., a duplex comprising the sense sequence in the same row of the table. Column 8 indicates the position in the target mRNA (NM_001365536.1) that is complementary to the antisense strand of Column 7. Column 9 indicated the sequence ID for the sequence of column 8.

| Duplex Name | Sense sequence name | Seq ID NO: (sense) | Sense sequence (5'-3') | Antisense sequence name | Seq ID NO: (anti sense) | Antisense sequence (5'-3') | mRNA target sequence in NM_00136 5536.1 | SEQ ID NO: (mRNA target) |
|---|---|---|---|---|---|---|---|---|
| AD-1251342.1 | A-2337548.1 | 4063 | gsusguaggagdGadAuuca(Chd)uuuuaL96 | A-2337549.1 | 4329 | VPudAaadAgdTgaaudTcUfcCfuacacsgsg | CUGUGUAGGAGAAUUCACUUUUC | 4595 |
| AD-1251347.1 | A-2337481.1 | 4064 | usgsuaggagdAaUfucac(Uhd)uuucaL96 | A-2337555.1 | 4330 | VPusdGsaadAa(G2p)ugaadTuCfuCfcuacasesg | UGUGUAGGAGAAUUCACUUUUCU | 4596 |
| AD-795371.3 | A-1522828.1 | 4065 | usgsuag(Ghd)AfgAfAfUfucacuuuucaL96 | A-1522829.1 | 4331 | VPusGfsaaaAfgUfGfaauuCfuCfcuacascsa | UGUGUAGGAGAAUUCACUUUUCU | 4597 |
| AD-1010663.3 | A-1851796.1 | 4066 | usgsuag(Ghd)agdAadTucacuuuucaL96 | A-1875201.1 | 4332 | VPusdGsaadAadGugaadTudCudCcuacascsa | UGUGUAGGAGAAUUCACUUUUCU | 4598 |
| AD-1251301.1 | A-2337482.1 | 4067 | usgsuaggagdAaUfUfcac(Uhd)uuucaL96 | A-2337486.1 | 4333 | VPudGaadAa(G2p)ugaadTudCudCcuacascsg | UGUGUAGGAGAAUUCACUUUUCU | 4599 |
| AD-1251348.1 | A-2337556.1 | 4068 | usgsuaggagdAaUfucau(Uhd)uuucaL96 | A-2337557.1 | 4334 | VPusdGsaadAadAugaadTuCfuCfcuacascsg | UGUGUAGGAGAAUUCACUUUUCU | 4600 |
| AD-1251343.1 | A-2337550.1 | 4069 | usgsuaggAfgAfAfUfucac(Uhd)uuucaL96 | A-1522829.1 | 4335 | VPusGfsaaaAfgUfGfaauuCfuCfcuacascsa | UGUGUAGGAGAAUUCACUUUUCU | 4601 |
| AD-1251346.1 | A-2337550.1 | 4070 | usgsuaggAfgAfAfUfucac(Uhd)uuucaL96 | A-2337554.1 | 4336 | VPusdGsaadAa(G2p)ugaauuCfuCfcuascsg | UGUAGGAGAAUUCACUUUUCU | 4602 |
| AD-1251299.1 | A-2337476.1 | 4071 | usgsuaggagdAadTucac(Uhd)uuucaL96 | A-2337486.1 | 4337 | VPudGaadAa(G2p)ugaadTudCudCcuacascsg | UGUGUAGGAGAAUUCACUUUUCU | 4603 |
| AD-1251345.1 | A-2337552.1 | 4072 | usgsuaggAfgAfAfUfucau(Uhd)uuucaL96 | A-2337553.1 | 4338 | VPusdGsaadAadAugaauuCfuCfcuacascsg | UGUGUAGGAGAAUUCACUUUUCU | 4604 |
| AD-1251349.1 | A-2337481.1 | 4073 | usgsuaggagdAaUfucac(Uhd)uuucaL96 | A-2337558.1 | 4339 | VPudGaadAa(G2p)ugaadTuCfuCfcuacascsg | UGUGUAGGAGAAUUCACUUUUCU | 4605 |
| AD-1251292.1 | A-2337476.1 | 4074 | usgsuaggagdAadTucac(Uhd)uuucaL96 | A-2337477.1 | 4340 | VPusdGsaadAadGugaadTudCudCcuacascsg | UGUGUAGGAGAAUUCACUUUUCU | 4606 |
| AD-1251293.1 | A-2337476.1 | 4075 | usgsuaggagdAadTucac(Uhd)uuucaL96 | A-2337478.1 | 4341 | VPusdGsaadAa(G2p)ugaadTudCudCcuacascsg | UGUGUAGGAGAAUUCACUUUUCU | 4607 |
| AD-1251294.1 | A-2337479.1 | 4076 | usgsuaggagdAadTucau(Uhd)uuucaL96 | A-2337480.1 | 4342 | VPusdGsaadAadAugaadTudCudCcuacascsg | UGUGUAGGAGAAUUCACUUUUCU | 4608 |
| AD-1251344.1 | A-2337550.1 | 4077 | usgsuaggAfgAfAfUfucac(Uhd)uuucaL96 | A-2337551.1 | 4343 | VPusdGsaadAa(G2p)ugaauuCfuCfcuacascsg | UGUGUAGGAGAAUUCACUUUUCU | 4609 |

TABLE 13A-continued

Exemplary Human SCN9A siRNA Modified Single Strands and Duplex Sequences
Column 1 indicates duplex name and the number following the decimal point in a duplex name merely refers to a batch production number. Column 2 indicates the name of the sense sequence. Column 3 indicates the sequence ID for the sequence of column 4. Column 4 provides the modified sequence of a sense strand suitable for use in a duplex described herein. Column 5 indicates the antisense sequence name. Column 6 indicates the sequence ID for the sequence of column 7. Column 7 provides the sequence of a modified antisense strand suitable for use in a duplex described herein, e.g., a duplex comprising the sense sequence in the same row of the table. Column 8 indicates the position in the target mRNA (NM_001365536.1) that is complementary to the antisense strand of Column 7. Column 9 indicated the sequence ID for the sequence of column 8.

| Duplex Name | Sense sequence name | Seq ID NO: (sense) | Sense sequence (5'-3') | Antisense sequence name | Seq ID NO: (anti sense) | Antisense sequence (5'-3') | mRNA target sequence in NM_00136 5536.1 | SEQ ID NO: (mRNA target) |
|---|---|---|---|---|---|---|---|---|
| AD-1251300.1 | A-2337481.1 | 4078 | usgsuaggagdAaUfucac(Uhd)uuucaL96 | A-2337486.1 | 4344 | VPudGaadAa(G2p)ugaadTudCudCcuacascsg | UGUGUAGGAGAAUUCACUUUUCU | 4610 |
| AD-1251295.1 | A-2337481.1 | 4079 | usgsuaggagdAaUfucac(Uhd)uuucaL96 | A-2337478.1 | 4345 | VPusdGsaadAa(G2p)ugaadTudCudCcuacascsg | UGUGUAGGAGAAUUCACUUUUCU | 4611 |
| AD-1251296.1 | A-2337482.1 | 4080 | usgsuaggagdAaUfufcac(Uhd)uuucaL96 | A-2337478.1 | 4346 | VPusdGsaadAa(G2p)ugaadTudCudCcuacascsg | UGUGUAGGAGAAUUCACUUUUCU | 4612 |
| AD-1251350.1 | A-2337559.1 | 4081 | gsusaggagaAfUfUfcacu(Uhd)uucuaL96 | A-2337560.1 | 4347 | VPusAfsgadAadAgugaauUfcUfccuacsgsc | GUGUAGGAGAAUUCACUUUUCUU | 4613 |
| AD-1251351.1 | A-2337561.1 | 4082 | gsusaggagaaUfUfcacu(Uhd)uucuaL96 | A-2337562.1 | 4348 | VPudAgadAadAgugaauUfcUfccuacsgsc | GUGUAGGAGAAUUCACUUUUCUU | 4614 |
| AD-1251353.1 | A-2337565.1 | 4083 | usasggagaaUfUfCfacuu(Uhd)ucuuaL96 | A-2337566.1 | 4349 | VPusdAsagdAadAagugaaUfuCfuccuascsg | UGUAGGAGAAUUCACUUUUCUUC | 4615 |
| AD-1251352.1 | A-2337563.1 | 4084 | usasggagAfaUfUfCfacuu(Uhd)ucuuaL96 | A-2337564.1 | 4350 | VPusAfsagdAadAagugaaUfuCfuccuascsg | UGUAGGAGAAUUCACUUUUCUUC | 4616 |
| AD-1251298.1 | A-2337485.1 | 4085 | usasggagdAaUfUfcac(Uhd)uuucaL96 | A-2337484.1 | 4351 | VPusdGsaadAa(G2p)ugaadTudCudCcuascsg | UGUAGGAGAAUUCACUUUUCU | 4617 |
| AD-1251297.1 | A-2337483.1 | 4086 | usasggagdAaUfucac(Uhd)uuucaL96 | A-2337484.1 | 4352 | VPusdGsaadAa(G2p)ugaadTudCudCcuascsg | UGUAGGAGAAUUCACUUUUCU | 4618 |
| AD-1251354.1 | A-2337567.1 | 4087 | asgsgagaauUfcdAcuuu(Uhd)cuucaL96 | A-2337568.1 | 4353 | VPudGaadGadAaagudGaAfuUfcuccusgsc | GUAGGAGAAUUCACUUUUCUUCG | 4619 |
| AD-1251355.1 | A-2337569.1 | 4088 | gsgsagaaUfuCfAfCfuuuu(Chd)uucgaL96 | A-2337570.1 | 4354 | VPusCfsgadAgdAaaagugAfaUfucuccsusg | UAGGAGAAUUCACUUUUCUUCGU | 4620 |
| AD-1251356.1 | A-2337571.1 | 4089 | gsgsagaaUfuCfaCfuuuu(Chd)uucgaL96 | A-2337572.1 | 4355 | VPuCfgadAgdAaaagdTgdAaUfucuccsusg | UAGGAGAAUUCACUUUUCUUCGU | 4621 |
| AD-1251357.1 | A-2337573.1 | 4090 | gsasgaa(Uhd)UfcaCfUfuuucuucguaL96 | A-2337574.1 | 4356 | VPudAcgdAadGaaaadGudGadAuucucscsu | AGGAGAAUUCACUUUUCUUCGUG | 4622 |
| AD-1251358.1 | A-2337575.1 | 4091 | cscsugaagcAfUfAfaaug(Uhd)uuucaL96 | A-2337576.1 | 4357 | VPusdGsaadAadCauuudAudGcUfucaggsusu | AACCUGAAGCAUAAAUGUUUUCG | 4623 |
| AD-1251359.1 | A-2337577.1 | 4092 | csusgaagCfaUfAfAfaugu(Uhd)uucgaL96 | A-2337578.1 | 4358 | VPusCfsgadAadAcauuuaUfgCfuucagsgsu | ACCUGAAGCAUAAAUGUUUUCGA | 4624 |

TABLE 13A-continued

Exemplary Human SCN9A siRNA Modified Single Strands and Duplex Sequences Column 1 indicates duplex name and the number following the decimal point in a duplex name merely refers to a batch production number. Column 2 indicates the name of the sense sequence. Column 3 indicates the sequence ID for the sequence of column 4. Column 4 provides the modified sequence of a sense strand suitable for use in a duplex described herein. Column 5 indicates the antisense sequence name. Column 6 indicates the sequence ID for the sequence of column 7. Column 7 provides the sequence of a modified antisense strand suitable for use in a duplex described herein, e.g., a duplex comprising the sense sequence in the same row of the table. Column 8 indicates the position in the target mRNA (NM_001365536.1) that is complementary to the antisense strand of Column 7. Column 9 indicated the sequence ID for the sequence of column 8.

| Duplex Name | Sense sequence name | Seq ID NO: (sense) | Sense sequence (5'-3') | Antisense sequence name | Seq ID NO: (anti sense) | Antisense sequence (5'-3') | mRNA target sequence in NM_001365536.1 | SEQ ID NO: (mRNA target) |
|---|---|---|---|---|---|---|---|---|
| AD-1251360.1 | A-2337579.1 | 4093 | csusgaagcadTadAaugu(Uhd)uucgaL96 | A-2337580.1 | 4359 | VPuCfgadAadAcauuuaUfgCfuucagsgsu | ACCUGAAGCAUAAAUGUUUCGA | 4625 |
| AD-1251361.1 | A-1852317.1 | 4094 | usgsaag(Chd)audAadAuguuuucgaaL96 | A-2337581.1 | 4360 | VPuUfcgdAadAacaudTuAfudGcuucasgsg | CCUGAAGCAUAAAUGUUUCGAA | 4626 |
| AD-1251363.1 | A-2337584.1 | 4095 | gsasagcauadAaUfguuu(Uhd)cgaaaL96 | A-2337585.1 | 4361 | VPuUfucdGadAaacadTuUfaUfgcuucsasg | CUGAAGCAUAAAUGUUUCGAAA | 4627 |
| AD-1251362.1 | A-2337582.1 | 4096 | gsasagcaUfaAfAfUfguuu(Uhd)cgaaaL96 | A-2337583.1 | 4362 | VPusUfsucdGadAaacauuUfaUfgcuucsasg | CUGAAGCAUAAAUGUUUCGAAA | 4628 |
| AD-1251364.1 | A-1812604.1 | 4097 | asasgca(Uhd)aadAudGuuuucgaaaaL96 | A-2337586.1 | 4363 | VPuUfuudCgdAaaacdAuUfudAugcuuscsg | UGAAGCAUAAAUGUUUCGAAAU | 4629 |
| AD-1251372.1 | A-2337591.1 | 4098 | asgscauaaaUfgUfuuu(Chd)gaaauaL96 | A-2337598.1 | 4364 | VPudAuudTc(G2p)aaaadCaUfuUfaugcususc | GAAGCAUAAAUGUUUCGAAAUU | 4630 |
| AD-1251366.1 | A-2337589.1 | 4099 | asgscauaAfaUfGfUfuuu(Chd)gaaauaL96 | A-1523300.1 | 4365 | VPusAfsuuuCfgAfAfaacaUfuUfaugcususc | GAAGCAUAAAUGUUUCGAAAUU | 4631 |
| AD-1251367.1 | A-2337589.1 | 4100 | asgscauaAfaUfGfUfuuu(Chd)gaaauaL96 | A-2337590.1 | 4366 | VPusAfsuudTc(G2p)aaaacaUfuUfaugcusus c | GAAGCAUAAAUGUUUCGAAAUU | 4632 |
| AD-795634.4 | A-1523299.1 | 4101 | asgscau(Ahd)AfaUfGfUfuuucgaaauaL96 | A-1523300.1 | 4367 | VPusAfsuuuCfgAfAfaacaUfuUfaugcususc | GAAGCAUAAAUGUUUCGAAAUU | 4633 |
| AD-1251369.1 | A-2337593.1 | 4102 | asgscauaaaUfgUfuuu(Uhd)gaaauaL96 | A-2337594.1 | 4368 | VPusAfsuudTcdAaaaadCaUfuUfaugcususc | GAAGCAUAAAUGUUUCGAAAUU | 4634 |
| AD-1251368.1 | A-2337591.1 | 4103 | asgscauaaaUfgUfuuu(Chd)gaaauaL96 | A-2337592.1 | 4369 | VPusAfsuudTc(G2p)aaaadCaUfuUfaugcususc | GAAGCAUAAAUGUUUCGAAAUU | 4635 |
| AD-1251373.1 | A-2337591.1 | 4104 | asgscauaaaUfgUfuuu(Chd)gaaauaL96 | A-2337599.1 | 4370 | VPudAuudTc(G2p)aaaadCaUfuUfaugcuscsc | GAAGCAUAAAUGUUUCGAAAUU | 4636 |
| AD-1251365.1 | A-2337587.1 | 4105 | asgsca(Uhd)aaaUfgUfuuucgaaauaL96 | A-2337588.1 | 4371 | VPudAuudTcdGaaaadCaUfuUfaugcususc | GAAGCAUAAAUGUUUCGAAAUU | 4637 |
| AD-1251370.1 | A-2337591.1 | 4106 | asgscauaaaUfgUfuuu(Chd)gaaauaL96 | A-2337595.1 | 4372 | VPusdAsuudTc(G2p)aaaadCaUfuUfaugcuscsc | GAAGCAUAAAUGUUUCGAAAUU | 4638 |
| AD-1251374.1 | A-2337600.1 | 4107 | gscsa(Uhd)aaaugUfUfuucgaaauuaL96 | A-2337601.1 | 4373 | VPusdAsaudTu(C2p)gaaaacAfuUfuaugcsusu | AAGCAUAAAUGUUUCGAAAUUC | 4639 |

TABLE 13A-continued

Exemplary Human SCN9A siRNA Modified Single Strands and Duplex Sequences Column 1 indicates duplex name and the number following the decimal point in a duplex name merely refers to a batch production number. Column 2 indicates the name of the sense sequence. Column 3 indicates the sequence ID for the sequence of column 4. Column 4 provides the modified sequence of a sense strand suitable for use in a duplex described herein. Column 5 indicates the antisense sequence name. Column 6 indicates the sequence ID for the sequence of column 7. Column 7 provides the sequence of a modified antisense strand suitable for use in a duplex described herein, e.g., a duplex comprising the sense sequence in the same row of the table. Column 8 indicates the position in the target mRNA (NM_001365536.1) that is complementary to the antisense strand of Column 7. Column 9 indicated the sequence ID for the sequence of column 8.

| Duplex Name | Sense sequence name | Seq ID NO: (sense) | Sense sequence (5'-3') | Antisense sequence name | Seq ID NO: (anti sense) | Antisense sequence (5'-3') | mRNA target sequence in NM_001365536.1 | SEQ ID NO: (mRNA target) |
|---|---|---|---|---|---|---|---|---|
| AD-1251375.1 | A-2337602.1 | 4108 | csasuaaa(Uhd)gUfUfUfucgaaauucaL96 | A-2337603.1 | 4374 | VPusdGsaadTu(Tgn)cgaaaaCfaUfuuaugscsu | AGCAUAAAUGUUUUCGAAAUUCA | 4640 |
| AD-1251371.1 | A-2337596.1 | 4109 | csasuaaaUfgUfuuu(Chd)gaaauaL96 | A-2337597.1 | 4375 | VPusdAsuudTc(G2p)aaaadCaUfuUfaugscsu | AGCAUAAAUGUUUUCGAAAUU | 4641 |
| AD-1251376.1 | A-2337604.1 | 4110 | asusaaa(Uhd)guUfUfUfcgaaauucaaL96 | A-2337605.1 | 4376 | VPusUfsgadAudTucgaaaAfcAfuuuausgsc | GCAUAAAUGUUUUCGAAAUUCAC | 4642 |
| AD-1251377.1 | A-2337604.1 | 4111 | asusaaa(Uhd)guUfUfUfcgaaauucaaL96 | A-2337606.1 | 4377 | VPusUfsgadAudTucgaaaAfcAfuuuausgsu | GCAUAAAUGUUUUCGAAAUUCAC | 4643 |
| AD-1251378.1 | A-2337607.1 | 4112 | usasaaugUfuUfuCfgaaa(Uhd)ucacaL96 | A-2337608.1 | 4378 | VPudGugdAadTuucgdAadAaCfauuuasusg | CAUAAAUGUUUUCGAAAUUCACU | 4644 |
| AD-1251379.1 | A-2337609.1 | 4113 | asasaug(Uhd)uuUfucdGaaauucacuaL96 | A-2337610.1 | 4379 | VPudAgudGa(A2p)uuucdGaAfaAfcauuusgsu | AUAAAUGUUUUCGAAAUUCACUU | 4645 |
| AD-1251380.1 | A-2337611.1 | 4114 | usasca(Uhd)gAfuCfUfUfcuuugucguaL96 | A-2337612.1 | 4380 | VPusAfscgdAcdAaagaagAfuCfauguasgsg | CCUACAUGAUCUUCUUUGUCGUA | 4646 |
| AD-1251381.1 | A-2337613.1 | 4115 | usasca(Uhd)gauCfUfUfcuuugucguaL96 | A-2337614.1 | 4381 | VPudAscgdAcdAaagaagAfuCfauguascsc | CCUACAUGAUCUUCUUUGUCGUA | 4647 |
| AD-1251382.1 | A-2337615.1 | 4116 | ascsaugaUfcUfUfCfuuug(Uhd)cguaaL96 | A-2337616.1 | 4382 | VPuUfacdGa(C2p)aaagdAadGaUfcaugusgsg | CUACAUGAUCUUCUUUGUCGUAG | 4648 |
| AD-1251384.1 | A-1523843.1 | 4117 | csasuga(Uhd)CfuUfCfUfuugucguagaL96 | A-2337457.1 | 4383 | VPuCfuadCgdAcaaadGadAgdAucaugsusg | UACAUGAUCUUCUUUGUCGUAGU | 4649 |
| AD-1251274.2 | A-2337449.1 | 4118 | csasuga(Uhd)cuUfCfUfuugucguagaL96 | A-2337457.1 | 4384 | VPuCfuadCgdAcaaadGadAgdAucaugsusg | UACAUGAUCUUCUUUGUCGUAGU | 4650 |
| AD-961188.3 | A-1812612.1 | 4119 | csasuga(Uhd)cudTcdTuugucguagaL96 | A-1812613.1 | 4385 | VPusdCsuadCgdAcaaadGadAgdAucaugsusa | UACAUGAUCUUCUUUGUCGUAGU | 4651 |
| AD-1251383.1 | A-1523843.1 | 4120 | csasuga(Uhd)CfuUfCfUfuugucguagaL96 | A-2337617.1 | 4386 | VPusCfsuadCgdAcaaagaAfgAfucaugsusg | UACAUGAUCUUCUUUGUCGUAGU | 4652 |
| AD-1251269.1 | A-2337449.1 | 4121 | csasuga(Uhd)cuUfCfUfuugucguagaL96 | A-2337451.1 | 4387 | VPusCfsuadCgdAcaaadGadAgdAucaugsusg | UACAUGAUCUUCUUUGUCGUAGU | 4653 |
| AD-1251270.1 | A-2337449.1 | 4122 | csasuga(Uhd)cuUfCfUfuugucguagaL96 | A-2337452.1 | 4388 | VPusdCsuadCgdAcaadGadAgdAucaugscsc | UACAUGAUCUUCUUUGUCGUAGU | 4654 |

TABLE 13A-continued

Exemplary Human SCN9A siRNA Modified Single Strands and Duplex Sequences
Column 1 indicates duplex name and the number following the decimal point in a duplex name merely refers to a batch production number. Column 2 indicates the name of the sense sequence. Column 3 indicates the sequence ID for the sequence of column 4. Column 4 provides the modified sequence of a sense strand suitable for use in a duplex described herein. Column 5 indicates the antisense sequence name. Column 6 indicates the sequence ID for the sequence of column 7. Column 7 provides the sequence of a modified antisense strand suitable for use in a duplex described herein, e.g., a duplex comprising the sense sequence in the same row of the table. Column 8 indicates the position in the target mRNA (NM_001365536.1) that is complementary to the antisense strand of Column 7. Column 9 indicated the sequence ID for the sequence of column 8.

| Duplex Name | Sense sequence name | Seq ID NO: (sense) | Sense sequence (5'-3') | Antisense sequence name | Seq ID NO: (anti sense) | Antisense sequence (5'-3') | mRNA target sequence in NM_001365536.1 | SEQ ID NO: (mRNA target) |
|---|---|---|---|---|---|---|---|---|
| AD-1251268.1 | A-2337449.1 | 4123 | csasuga(Uhd)cuUfCfUfuugucguagaL96 | A-2337450.1 | 4389 | VPusdCsuadCgdAcaaadGadAgdAucaugsusg | UACAUGAUCUUCUUUGUCGUAGU | 4655 |
| AD-1251274.1 | A-2337449.1 | 4124 | csasuga(Uhd)cuUfCfUfuugucguagaL96 | A-2337457.1 | 4390 | VPuCfuadCgdAcaaadGadAgdAucaugsusg | UACAUGAUCUUCUUUGUCGUAGU | 4656 |
| AD-1251271.1 | A-2337449.1 | 4125 | csasuga(Uhd)cuUfCfUfuugucguagaL96 | A-2337453.1 | 4391 | VPusCfsuadCgdAcaaadGadAgdAucaugscsc | UACAUGAUCUUCUUUGUCGUAGU | 4657 |
| AD-1251275.2 | A-2337449.1 | 4126 | csasuga(Uhd)cuUfCfUfuugucguagaL96 | A-2337458.1 | 4392 | VPudCuadCgdAcaaadGadAgdAucaugsusg | UACAUGAUCUUCUUUGUCGUAGU | 4658 |
| AD-1251275.1 | A-2337449.1 | 4127 | csasuga(Uhd)cuUfCfUfuugucguagaL96 | A-2337458.1 | 4393 | VPudCuadCgdAcaaadGadAgdAucaugsusg | UACAUGAUCUUCUUUGUCGUAGU | 4659 |
| AD-1251385.1 | A-1523845.1 | 4128 | asusgau(Chd)UfuCfUfUfugucguaguaL96 | A-2337618.1 | 4394 | VPudAcudAcdGacaadAgdAadGaucausgsu | ACAUGAUCUUCUUUGUCGUAGUG | 4660 |
| AD-1251272.1 | A-2337454.1 | 4129 | usgsaucuUfCfUfuugu(Chd)guagaL96 | A-2337455.1 | 4395 | VPusdCsuadCgdAcaaadGadAgdAucasusg | CAUGAUCUUCUUUGUCGUAGU | 4661 |
| AD-1251386.1 | A-1523847.1 | 4130 | usgsauc(Uhd)UfcUfUfUfgucguagugaL96 | A-2337619.1 | 4396 | VPudCacdTadCgacadAadGadAgaucasusg | CAUGAUCUUCUUUGUCGUAGUGA | 4662 |
| AD-1251273.1 | A-2337454.1 | 4131 | usgsaucuUfCfUfuugu(Chd)guagaL96 | A-2337456.1 | 4397 | VPusCfsuadCgdAcaaadGadAgdAucasusg | CAUGAUCUUCUUUGUCGUAGU | 4663 |
| AD-1251390.1 | A-2337622.1 | 4132 | gsasucu(Uhd)CfuUfudGucguagugaaL96 | A-2337624.1 | 4398 | VPusUfscadCu(A2p)cgacdAaAfgAfagaucsgsu | AUGAUCUUCUUUGUCGUAGUGAU | 4664 |
| AD-1251398.1 | A-2337622.1 | 4133 | gsasucu(Uhd)CfuUfudGucguagugaaL96 | A-2337630.1 | 4399 | VPuUfcadCu(A2p)cgacdAaAfgAfagaucsgsu | AUGAUCUUCUUUGUCGUAGUGAU | 4665 |
| AD-1251396.1 | A-2337629.1 | 4134 | gsasucu(Uhd)CfuUfUfgUfCfguagugaaL96 | A-2337621.1 | 4400 | VPusUfscadCu(A2p)cgacaaAfgAfagaucsgsu | AUGAUCUUCUUUGUCGUAGUGAU | 4666 |
| AD-1251399.1 | A-2337628.1 | 4135 | gsasucu(Uhd)CfuUfudGUfcguagugaaL96 | A-2337630.1 | 4401 | VPuUfcadCu(A2p)cgacdAaAfgAfagaucsgsu | AUGAUCUUCUUUGUCGUAGUGAU | 4667 |
| AD-795913.3 | A-1523849.1 | 4136 | gsasucu(Uhd)CfuUfUfGfucguagugaaL96 | A-1523850.1 | 4402 | VPusUfscacUfaCfGfacaaAfgAfagaucsasu | AUGAUCUUCUUUGUCGUAGUGAU | 4668 |
| AD-1251400.1 | A-2337629.1 | 4137 | gsasucu(Uhd)CfuUfUfgUfCfguagugaaL96 | A-2337631.1 | 4403 | VPuUfcadCu(A2p)cgacaaAfgAfagaucsgsu | AUGAUCUUCUUUGUCGUAGUGAU | 4669 |

TABLE 13A-continued

Exemplary Human SCN9A siRNA Modified Single Strands and Duplex Sequences Column 1 indicates duplex name and the number following the decimal point in a duplex name merely refers to a batch production number. Column 2 indicates the name of the sense sequence. Column 3 indicates the sequence ID for the sequence of column 4. Column 4 provides the modified sequence of a sense strand suitable for use in a duplex described herein. Column 5 indicates the antisense sequence name. Column 6 indicates the sequence ID for the sequence of column 7. Column 7 provides the sequence of a modified antisense strand suitable for use in a duplex described herein, e.g., a duplex comprising the sense sequence in the same row of the table. Column 8 indicates the position in the target mRNA (NM_001365536.1) that is complementary to the antisense strand of Column 7. Column 9 indicated the sequence ID for the sequence of column 8.

| Duplex Name | Sense sequence name | Seq ID NO: (sense) | Sense sequence (5'-3') | Antisense sequence name | Seq ID NO: (anti sense) | Antisense sequence (5'-3') | mRNA target sequence in NM_001365536.1 | SEQ ID NO: (mRNA target) |
|---|---|---|---|---|---|---|---|---|
| AD-1251388.1 | A-1523849.1 | 4138 | gsasucu(Uhd)CfuUfUfGfucguagugaaL96 | A-2337621.1 | 4404 | VPusUfscadCu(A2p)cgacaaAfgAfagaucsgsu | AUGAUCUUCUUUGUCGUAGUGAU | 4670 |
| AD-1251397.1 | A-1812618.1 | 4139 | gsasucu(Uhd)cudTudGucguagugaaL96 | A-2337624.1 | 4405 | VPusUfscadCu(A2p)cgacdAaAfgAfagaucsgSU | AUGAUCUUCUUUGUCGUAGUGAU | 4671 |
| AD-1251395.1 | A-2337628.1 | 4140 | gsasucu(Uhd)CfuUfudGUfcguagugaaL96 | A-2337624.1 | 4406 | VPusUfscadCu(A2p)cgacdAaAfgAfagaucsgsu | AUGAUCUUCUUUGUCGUAGUGAU | 4672 |
| AD-1251387.1 | A-1523849.1 | 4141 | gsasucu(Uhd)CfuUfUfGfucguagugaaL96 | A-2337620.1 | 4407 | VPusUfscadCu(Agn)cgacaaAfgAfagaucsgsu | AUGAUCUUCUUUGUCGUAGUGAU | 4673 |
| AD-1251389.1 | A-2337622.1 | 4142 | gsasucu(Uhd)CfuUfudGucguagugaaL96 | A-2337623.1 | 4408 | VPusUfscadCu(Agn)cgacdAaAfgAfagaucsgsu | AUGAUCUUCUUUGUCGUAGUGAU | 4674 |
| AD-1251393.1 | A-2337628.1 | 4143 | gsasucu(Uhd)CfuUfudGUfcguagugaaL96 | A-2337623.1 | 4409 | VPusUfscadCu(Agn)cgacdAaAfgAfagaucsgsu | AUGAUCUUCUUUGUCGUAGUGAU | 4675 |
| AD-1251394.1 | A-2337629.1 | 4144 | gsasucu(Uhd)CfuUfUfgUfCfguagugaaL96 | A-2337620.1 | 4410 | VPusUfscadCu(Agn)cgacaaAfgAfagaucsgsu | AUGAUCUUCUUUGUCGUAGUGAU | 4676 |
| AD-1251401.1 | A-2337632.1 | 4145 | asuscuu(Chd)UfuUfgUfcguagugauaL96 | A-2337633.1 | 4411 | VPudAsucdAc(Tgn)acgadCaAfadGaagauscsg | UGAUCUUCUUUGUCGUAGUGAUU | 4677 |
| AD-1251391.1 | A-2337625.1 | 4146 | uscsu(Uhd)CfuUfudGucguagugaaL96 | A-2337626.1 | 4412 | VPusUfscadCu(Agn)cgacdAaAfgAfagasusc | GAUCUUCUUUGUCGUAGUGAU | 4678 |
| AD-1251392.1 | A-2337625.1 | 4147 | uscsu(Uhd)CfuUfudGucguagugaaL96 | A-2337627.1 | 4413 | VPusUfscadCu(A2p)cgacdAaAfgAfagasusc | GAUCUUCUUUGUCGUAGUGAU | 4679 |
| AD-1251402.1 | A-2337634.1 | 4148 | uscsuuc(Uhd)UfugUfCfguagugauuaL96 | A-2337635.1 | 4414 | VPudAaudCa(C2p)uacgacAfaAfgaagasusc | GAUCUUCUUUGUCGUAGUGAUUU | 4680 |
| AD-1251403.1 | A-2337636.1 | 4149 | csusucu(Uhd)ugUfcdGuagugauuuaL96 | A-2337637.1 | 4415 | VPudAaadTc(A2p)cuacdGaCfaAfagaagsgsu | AUCUUCUUUGUCGUAGUGAUUUU | 4681 |
| AD-1251404.1 | A-2337638.1 | 4150 | ususcuu(Uhd)guCfgUfagugauuuuaL96 | A-2337639.1 | 4416 | VPudAaadAu(C2p)acuadCgAfcAfaagaasgsg | UCUUCUUUGUCGUAGUGAUUUUC | 4682 |
| AD-1251405.1 | A-2337640.1 | 4151 | uscsuuugUfcgUfAfguga(Uhd)uuucaL96 | A-2337641.1 | 4417 | VPudGaadAadTcacudAcdGaCfaaagasgsg | CUUCUUUGUCGUAGUGAUUUUCC | 4683 |
| AD-1251406.1 | A-2337642.1 | 4152 | asusccu(Uhd)UfugUfAfgaucuugcaaL96 | A-2337643.1 | 4418 | VPusUfsgcdAa(G2p)aucuacAfaAfaggauscsc | GGAUCCUUUUGUAGAUCUUGCAA | 4684 |

TABLE 13A-continued

Exemplary Human SCN9A siRNA Modified Single Strands and Duplex Sequences
Column 1 indicates duplex name and the number following the decimal point in a duplex name merely refers to a batch production number. Column 2 indicates the name of the sense sequence. Column 3 indicates the sequence ID for the sequence of column 4. Column 4 provides the modified sequence of a sense strand suitable for use in a duplex described herein. Column 5 indicates the antisense sequence name. Column 6 indicates the sequence ID for the sequence of column 7. Column 7 provides the sequence of a modified antisense strand suitable for use in a duplex described herein, e.g., a duplex comprising the sense sequence in the same row of the table. Column 8 indicates the position in the target mRNA (NM_001365536.1) that is complementary to the antisense strand of Column 7. Column 9 indicated the sequence ID for the sequence of column 8.

| Duplex Name | Sense sequence name | Seq ID NO: (sense) | Sense sequence (5'-3') | Antisense sequence name | Seq ID NO: (anti sense) | Antisense sequence (5'-3') | mRNA target sequence in NM_001365536.1 | SEQ ID NO: (mRNA target) |
|---|---|---|---|---|---|---|---|---|
| AD-1251407.1 | A-2337644.1 | 4153 | uscscuu(Uhd)UfgUfadGaucuugcaaaL96 | A-2337645.1 | 4419 | VPusUfsugdCa(Agn)gaucdTaCfaAfaaggasuse | GAUCCUUUUGUAGAUCUUGCAAU | 4685 |
| AD-1251408.1 | A-1854629.1 | 4154 | cscsuuu(Uhd)gudAgdAucuugcaauaL96 | A-2337646.1 | 4420 | VPudAuudGc(A2p)agaudCuAfcAfaaaggsgsu | AUCCUUUUGUAGAUCUUGCAAUU | 4686 |
| AD-1251409.1 | A-2337647.1 | 4155 | csusuuugUfagAfUfcuug(Chd)aauuaL96 | A-2337648.1 | 4421 | VPusAfsaudTg(C2p)aagaucUfaCfaaaagsgsg | UCCUUUUGUAGAUCUUGCAAUUA | 4687 |
| AD-1251411.1 | A-2337650.1 | 4156 | ususuug(Uhd)agAfUfCfuugcaauuaaL96 | A-2337651.1 | 4422 | VPusUfsaadTu(G2p)caagauCfuAfcaaagscsc | | |
| AD-1251410.1 | A-1525635.1 | 4157 | ususuug(Uhd)AfgAfUfCfuugcaauuaaL96 | A-2337649.1 | 4423 | VPusUfsaadTu(G2p)caagauCfuAfcaaaasgsg | CCUUUUGUAGAUCUUGCAAUUAC | 4689 |
| AD-1251412.1 | A-2337652.1 | 4158 | ususug(Uhd)agaUfCfUfugcaauuacaL96 | A-2337653.1 | 4424 | VPusGfsuaaUfuGfCfaagaUfcUfacaaasgsg | CUUUUGUAGAUCUUGCAAUUACC | 4690 |
| AD-796825.3 | A-1525636.1 | 4159 | ususugu(Ahd)GfaUfCfUfugcaauuacaL96 | A-1257916.1 | 4425 | VPusGfsuaaUfuGfCfaagaUfcUfacaaasasg | CUUUUGUAGAUCUUGCAAUUACC | 4691 |
| AD-1251413.1 | A-2337652.1 | 4160 | ususug(Uhd)agaUfCfUfugcaauuacaL96 | A-2337654.1 | 4426 | VPusdGsuadAu(Tgn)gcaagaUfcUfacaaasgsg | CUUUUGUAGAUCUUGCAAUUACC | 4692 |
| AD-1251414.1 | A-2337652.1 | 4161 | ususug(Uhd)agaUfCfUfugcaauuacaL96 | A-2337655.1 | 4427 | VPusdGsuadAu(U2p)gcaagaUfcUfacaaasgsg | CUUUUGUAGAUCUUGCAAUUACC | 4693 |
| AD-1251415.1 | A-2337652.1 | 4162 | ususug(Uhd)agaUfCfUfugcaauuacaL96 | A-2337656.1 | 4428 | VPudGuadAu(Tgn)gcaagaUfcUfacaaasgsg | CUUUUGUAGAUCUUGCAAUUACC | 4694 |
| AD-1251416.1 | A-2337652.1 | 4163 | ususug(Uhd)agaUfCfUfugcaauuacaL96 | A-2337657.1 | 4429 | VPudGuadAu(U2p)gcaagaUfcUfacaaasgsg | CUUUUGUAGAUCUUGCAAUUACC | 4695 |
| AD-1251417.1 | A-2337658.1 | 4164 | ususguagauCfUfUfgcaa(Uhd)uaccaL96 | A-2337659.1 | 4430 | VPusdGsgudAa(U2p)ugcaagAfuCfuacaasgsg | UUUUGUAGAUCUUGCAAUUACCA | 4696 |
| AD-1251418.1 | A-2337660.1 | 4165 | usgsuagaUfcUfudGcaau(Uhd)accaaL96 | A-2337661.1 | 4431 | VPuUfggdTadAuugcdAadGaUfcuacasgsg | UUUGUAGAUCUUGCAAUUACCAU | 4697 |
| AD-1251419.1 | A-2337662.1 | 4166 | gsusaga(Uhd)CfuUfgCfaauuaccauaL96 | A-2337663.1 | 4432 | VPudAugdGudAauugdCaAfgAfucuacsgsg | UUGUAGAUCUUGCAAUUACCAUU | 4698 |
| AD-1251420.1 | A-2337664.1 | 4167 | usasgau(Chd)UfugCfAfauuaccauuaL96 | A-2337665.1 | 4433 | VPusAfsaudGg(Tgn)aauugcAfadGaucuascsg | UGUAGAUCUUGCAAUUACCAUUU | 4699 |

TABLE 13A-continued

Exemplary Human SCN9A siRNA Modified Single Strands and Duplex Sequences
Column 1 indicates duplex name and the number following the decimal point in a duplex name merely refers to a batch production number. Column 2 indicates the name of the sense sequence. Column 3 indicates the sequence ID for the sequence of column 4. Column 4 provides the modified sequence of a sense strand suitable for use in a duplex described herein. Column 5 indicates the antisense sequence name. Column 6 indicates the sequence ID for the sequence of column 7. Column 7 provides the sequence of a modified antisense strand suitable for use in a duplex described herein, e.g., a duplex comprising the sense sequence in the same row of the table. Column 8 indicates the position in the target mRNA (NM_001365536.1) that is complementary to the antisense strand of Column 7. Column 9 indicated the sequence ID for the sequence of column 8.

| Duplex Name | Sense sequence name | Seq ID NO: (sense) | Sense sequence (5'-3') | Antisense sequence name | Seq ID NO: (anti sense) | Antisense sequence (5'-3') | mRNA target sequence in NM_001365536.1 | SEQ ID NO: (mRNA target) |
|---|---|---|---|---|---|---|---|---|
| AD-1251421.1 | A-1525641.1 | 4168 | asgsauc(Uhd)UfgCfAfAfuuaccauuuaL96 | A-2337666.1 | 4434 | VPusAfsaadTg(G2p)uaauugCfaAfgaucusgsC | GUAGAUCUUGCAAUUACCAUUUG | 4700 |
| AD-1251422.1 | A-2337667.1 | 4169 | asgsauc(Uhd)ugCfadAuuaccauuuaL96 | A-2337668.1 | 4435 | VPudAaadTg(G2p)uaaudTgCfadAgaucusgsc | GUAGAUCUUGCAAUUACCAUUUG | 4701 |
| AD-1251423.1 | A-1856083.1 | 4170 | usasaau(Uhd)audGudGaaacaaaccaL96 | A-2337669.1 | 4436 | VPudGgudTu(G2p)uuucdAcAfuAfauuuasusu | AAUAAAUUAUGUGAAACAAACCU | 4702 |
| AD-1251425.1 | A-1856087.1 | 4171 | asasuua(Uhd)gudGadAacaaaccuuaL96 | A-2337672.1 | 4437 | VPudAagdGu(U2p)uguudTcAfcAfuaauususg | UAAAUUAUGUGAAACAAACCUUA | 4703 |
| AD-1251427.1 | A-2337675.1 | 4172 | asusuaugugdAadAcaaa(Chd)cuuaaL96 | A-2337676.1 | 4438 | VPuUfaadGg(Tgn)uugudTuCfaCfauaaususu | AAAUUAUGUGAAACAAACCUUAC | 4704 |
| AD-1251426.1 | A-2337673.1 | 4173 | asusuaugUfgAfAfAfcaaa(Chd)cuuaaL96 | A-2337674.1 | 4439 | VPusUfsaadGg(Tgn)uuguuuCfaCfauaaususu | AAAUUAUGUGAAACAAACCUUAC | 4705 |
| AD-1251428.1 | A-2337677.1 | 4174 | ususaug(Uhd)gaAfAfCfaaaccuuacaL96 | A-2337678.1 | 4440 | VPudGuadAg(G2p)uuuguuUfcAfcauaasusu | AAUUAUGUGAAACAAACCUUACG | 4706 |
| AD-797564.4 | A-1527042.1 | 4175 | usasugu(Ghd)AfaAfCfAfaaccuuacgaL96 | A-1527043.1 | 4441 | VPusCfsguaAfgGfUfuuguUfuCfacauasasu | AUUAUGUGAAACAAACCUUACGU | 4707 |
| AD-1251434.1 | A-2337679.1 | 4176 | usasugugAfaAfCfAfaacc(Uhd)uacgaL96 | A-2337687.1 | 4442 | VPuCfgudAa(G2p)guuuguUfuCfacauasgsu | AUUAUGUGAAACAAACCUUACGU | 4708 |
| AD-1251431.1 | A-2337681.1 | 4177 | usasugugAfaAfCfAfaacu(Uhd)uacgaL96 | A-2337682.1 | 4443 | VPusCfsgudAadAguuuguUfuCfacauasgsu | AUUAUGUGAAACAAACCUUACGU | 4709 |
| AD-1251433.1 | A-2337685.1 | 4178 | usasugugaadAcdAaacc(Uhd)uacgaL96 | A-2337686.1 | 4444 | VPusCfsgudAa(G2p)guuudGuUfuCfacauasgsu | AUUAUGUGAAACAAACCUUACGU | 4710 |
| AD-1251430.1 | A-2337679.1 | 4179 | usasugugAfaAfCfAfaacc(Uhd)uacgaL96 | A-2337680.1 | 4445 | VPusCfsgudAa(G2p)guuuguUfuCfacauasgsu | AUUAUGUGAAACAAACCUUACGU | 4711 |
| AD-1251429.1 | A-2337679.1 | 4180 | usasugugAfaAfCfAfaacc(Uhd)uacgaL96 | A-1527043.1 | 4446 | VPusCfsguaAfgGfUfuuguUfuCfacauasasu | AUUAUGUGAAACAAACCUUACGU | 4712 |
| AD-1251435.1 | A-2337685.1 | 4181 | usasugugaadAcdAaacc(Uhd)uacgaL96 | A-2337688.1 | 4447 | VPuCfgudAa(G2p)guuudGuUfuCfacauasgsu | AUUAUGUGAAACAAACCUUACGU | 4713 |
| AD-1251438.1 | A-2337689.1 | 4182 | asusgugaAfaCfAfAfaccu(Uhd)acguaL96 | A-2337691.1 | 4448 | VPusAfscgdTa(A2p)gguuugUfuUfcacausgsg | UUAUGUGAAACAAACCUUACGUG | 4714 |

TABLE 13A-continued

Exemplary Human SCN9A siRNA Modified Single Strands and Duplex Sequences
Column 1 indicates duplex name and the number following the decimal point in a duplex name merely refers to a batch production number. Column 2 indicates the name of the sense sequence. Column 3 indicates the sequence ID for the sequence of column 4. Column 4 provides the modified sequence of a sense strand suitable for use in a duplex described herein. Column 5 indicates the antisense sequence name. Column 6 indicates the sequence ID for the sequence of column 7. Column 7 provides the sequence of a modified antisense strand suitable for use in a duplex described herein, e.g., a duplex comprising the sense sequence in the same row of the table. Column 8 indicates the position in the target mRNA (NM_001365536.1) that is complementary to the antisense strand of Column 7. Column 9 indicated the sequence ID for the sequence of column 8.

| Duplex Name | Sense sequence name | Seq ID NO: (sense) | Sense sequence (5'-3') | Antisense sequence name | Seq ID NO: (anti sense) | Antisense sequence (5'-3') | mRNA target sequence in NM_001365536.1 | SEQ ID NO: (mRNA target) |
|---|---|---|---|---|---|---|---|---|
| AD-1251436.1 | A-2337689.1 | 4183 | asusgugaAfaCfAfAfaccu(Uhd)acguaL96 | A-1527045.1 | 4449 | VPusAfscguAfaGfGfuuugUfuUfcacausasa | UUAUGUGAAACAAACCUUACGUG | 4715 |
| AD-1251437.1 | A-2337689.1 | 4184 | asusgugaAfaCfAfAfaccu(Uhd)acguaL96 | A-2337690.1 | 4450 | VPusAfscgdTa(Agn)gguuugUfuUfcacausgsg | UUAUGUGAAACAAACCUUACGUG | 4716 |
| AD-797565.4 | A-1527044.1 | 4185 | asusgug(Ahd)AfaCfAfAfaccuuacguaL96 | A-1527045.1 | 4451 | VPusAfscguAfaGfGfuuugUfuUfcacausasa | UUAUGUGAAACAAACCUUACGUG | 4717 |
| AD-1251443.1 | A-2337689.1 | 4186 | asusgugaAfaCfAfAfaccu(Uhd)acguaL96 | A-2337698.1 | 4452 | VPuAfcgdTa(Agn)gguuugUfuUfcacausgsg | UUAUGUGAAACAAACCUUACGUG | 4718 |
| AD-1251444.1 | A-2337695.1 | 4187 | asusgugaaaCfadAaccu(Uhd)acguaL96 | A-2337699.1 | 4453 | VPudAcgdTa(A2p)gguudTgUfuUfcacausgsg | UUAUGUGAAACAAACCUUACGUG | 4719 |
| AD-1251442.1 | A-2337695.1 | 4188 | asusgugaaaCfadAaccu(Uhd)acguaL96 | A-2337697.1 | 4454 | VPusdAscgdTa(A2p)gguudTgUfuUfcacausgsg | UUAUGUGAAACAAACCUUACGUG | 4720 |
| AD-1251441.1 | A-2337695.1 | 4189 | asusgugaaaCfadAaccu(Uhd)acguaL96 | A-2337696.1 | 4455 | VPusdAscgdTa(Agn)gguudTgUfuUfcacausgsg | UUAUGUGAAACAAACCUUACGUG | 4721 |
| AD-1251445.1 | A-2337700.1 | 4190 | usgsugaaacdAadAccu(Uhd)acgugaL96 | A-2337701.1 | 4456 | VPusdCsacdGudAaggudTudGuUfucacasusg | UAUGUGAAACAAACCUUACGUGA | 4722 |
| AD-1251439.1 | A-2337692.1 | 4191 | gsusgaAfaCfAfAfaccu(Uhd)acguaL96 | A-2337693.1 | 4457 | VPusAfscgdTa(Agn)gguuugUfuUfcacsgsu | AUGUGAAACAAACCUUACGUG | 4723 |
| AD-1251447.1 | A-2337704.1 | 4192 | gsusgaaaCfadAaCfcuua(Chd)gugaaL96 | A-2337705.1 | 4458 | VPuUfcadCgdTaaggdTuUfgUfuucacsgsu | AUGUGAAACAAACCUUACGUGAA | 4724 |
| AD-1251446.1 | A-2337702.1 | 4193 | gsusgaaaCfaAfAfCfcuua(Chd)gugaaL96 | A-2337703.1 | 4459 | VPusUfscadCgdTaagguuUfgUfuucacsgsu | AUGUGAAACAAACCUUACGUGAA | 4725 |
| AD-1251448.1 | A-2337706.1 | 4194 | usgsaaa(Chd)aaaCfCfuuacgugaaaL96 | A-2337707.1 | 4460 | VPusUfsucdAc(G2p)uaagguUfudGuuucascsa | UGUGAAACAAACCUUACGUGAAU | 4726 |
| AD-1251450.1 | A-2337710.1 | 4195 | gsasaacaaaCfCfUfuacg(Uhd)gaauaL96 | A-2337711.1 | 4461 | VPusdAsuudCa(C2p)guaaggUfuUfguuucsasc | GUGAAACAAACCUUACGUGAAUU | 4727 |
| AD-1251449.1 | A-2337708.1 | 4196 | gsasaacaAfaCfCfUfuacg(Uhd)gaauaL96 | A-2337709.1 | 4462 | VPusAfsuudCa(C2p)guaaggUfuUfguuucsasc | GUGAAACAAACCUUACGUGAAUU | 4728 |
| AD-1251451.1 | A-2337712.1 | 4197 | asasacaaacCfUfUfacg(Uhd)gaauuaL96 | A-2337713.1 | 4463 | VPusdAsaudTc(A2p)cugadAgdGuUfuguuuscsg | | |

TABLE 13A-continued

Exemplary Human SCN9A siRNA Modified Single Strands and Duplex Sequences Column 1 indicates duplex name and the number following the decimal point in a duplex name merely refers to a batch production number. Column 2 indicates the name of the sense sequence. Column 3 indicates the sequence ID for the sequence of column 4. Column 4 provides the modified sequence of a sense strand suitable for use in a duplex described herein. Column 5 indicates the antisense sequence name. Column 6 indicates the sequence ID for the sequence of column 7. Column 7 provides the sequence of a modified antisense strand suitable for use in a duplex described herein, e.g., a duplex comprising the sense sequence in the same row of the table. Column 8 indicates the position in the target mRNA (NM_001365536.1) that is complementary to the antisense strand of Column 7. Column 9 indicated the sequence ID for the sequence of column 8.

| Duplex Name | Sense sequence name | Seq ID NO: (sense) | Sense sequence (5'-3') | Antisense sequence name | Seq ID NO: (anti sense) | Antisense sequence (5'-3') | mRNA target sequence in NM_001365536.1 | SEQ ID NO: (mRNA target) |
|---|---|---|---|---|---|---|---|---|
| AD-1251453.1 | A-2337716.1 | 4198 | usgsuga(Uhd)auaUfUfuuacaacauaL96 | A-2337717.1 | 4464 | VPudAugdTu(G2p)uaaaauAfuAfucacasgsu | AUUGUGAUAUAUUUUACAACAUC | 4730 |
| AD-1251452.1 | A-2337714.1 | 4199 | usgsuga(Uhd)AfuAfUfUfuuacaacauaL96 | A-2337715.1 | 4465 | VPusAfsugdTu(G2p)uaaaauAfuAfucacasgsu | AUUGUGAUAUAUUUUACAACAUC | 4731 |
| AD-1251454.1 | A-2337718.1 | 4200 | gsusga(Uhd)aUfaUfUfUfuacaacaucaL96 | A-2337719.1 | 4466 | VPudGaudGu(U2p)guaaaaUfaUfaucacsgsg | UUGUGAUAUAUUUUACAACAUCC | 4732 |
| AD-1251455.1 | A-2337720.1 | 4201 | usgsaua(Uhd)auUfUfUfacaacauccaL96 | A-2337721.1 | 4467 | VPudGgadTg(U2p)uguaaaAfuAfuaucascsg | UGUGAUAUAUUUUACAACAUCCG | 4733 |
| AD-1251456.1 | A-2337722.1 | 4202 | gsasua(Uhd)aUfuUfUfAfcaacauccgaL96 | A-2337723.1 | 4468 | VPusCfsggdAudGuuguaaAfaUfauaucsgsc | GUGAUAUAUUUUACAACAUCCGU | 4734 |
| AD-1251457.1 | A-2337724.1 | 4203 | gsasua(Uhd)aUfuUfudAcaacauccgaL96 | A-2337725.1 | 4469 | VPuCfggdAudGuugudAadAaUfauaucsgsc | GUGAUAUAUUUUACAACAUCCGU | 4735 |
| AD-1251459.1 | A-2337727.1 | 4204 | asusaua(Uhd)UfuUfaCfaacauccguaL96 | A-2337728.1 | 4470 | VPudAcgdGadTguugdTadAadAuauauscsg | UGAUAUAUUUUACAACAUCCGUU | 4736 |
| AD-1251458.1 | A-1535069.1 | 4205 | asusaua(Uhd)UfuUfAfCfaacauccguaL96 | A-2337726.1 | 4471 | VPusAfscgdGadTguuguaAfaAfuauauscsg | UGAUAUAUUUUACAACAUCCGUU | 4737 |
| AD-1251462.1 | A-1535071.1 | 4206 | usasuau(Uhd)UfuAfCfAfacauccguuaL96 | A-2337731.1 | 4472 | VPusAfsacdGg(Agn)uguuguAfaAfauauascsc | GAUAUAUUUUACAACAUCCGUUA | 4738 |
| AD-1251461.1 | A-1535071.1 | 4207 | usasuau(Uhd)UfuAfCfAfacauccguuaL96 | A-2337730.1 | 4473 | VPusAfsacdGg(A2p)uguuguAfaAfauauasusc | GAUAUAUUUUACAACAUCCGUUA | 4739 |
| AD-1251468.1 | A-1535071.1 | 4208 | usasuau(Uhd)UfuAfCfAfacauccguuaL96 | A-2337738.1 | 4474 | VPuAfacdGg(Agn)uguuguAfaAfauauascsc | GAUAUAUUUUACAACAUCCGUUA | 4740 |
| AD-1251463.1 | A-1535071.1 | 4209 | usasuau(Uhd)UfuAfCfAfacauccguuaL96 | A-2337732.1 | 4475 | VPusAfsacdGg(A2p)uguuguAfaAfauauasCSC | GAUAUAUUUUACAACAUCCGUUA | 4741 |
| AD-1251460.1 | A-1535071.1 | 4210 | usasuau(Uhd)UfuAfCfAfacauccguuaL96 | A-2337729.1 | 4476 | VPusAfsacdGg(Agn)uguuguAfaAfauauasusc | GAUAUAUUUUACAACAUCCGUUA | 4742 |
| AD-1251469.1 | A-1864159.1 | 4211 | usasuau(Uhd)uudAcdAacauccguuaL96 | A-2337739.1 | 4477 | VPudAacdGg(A2p)uguudGudAadAauauasuse | GAUAUAUUUUACAACAUCCGUUA | 4743 |
| AD-801647.3 | A-1535071.1 | 4212 | usasuau(Uhd)UfuAfCfAfacauccguuaL96 | A-1535072.1 | 4478 | VPusAfsacgGfaUfGfuuguAfaAfauauasusc | GAUAUAUUUUACAACAUCCGUUA | 4744 |

TABLE 13A-continued

Exemplary Human SCN9A siRNA Modified Single Strands and Duplex Sequences
Column 1 indicates duplex name and the number following the decimal point in a duplex name merely refers to a batch production number. Column 2 indicates the name of the sense sequence. Column 3 indicates the sequence ID for the sequence of column 4. Column 4 provides the modified sequence of a sense strand suitable for use in a duplex described herein. Column 5 indicates the antisense sequence name. Column 6 indicates the sequence ID for the sequence of column 7. Column 7 provides the sequence of a modified antisense strand suitable for use in a duplex described herein, e.g., a duplex comprising the sense sequence in the same row of the table. Column 8 indicates the position in the target mRNA (NM_001365536.1) that is complementary to the antisense strand of Column 7. Column 9 indicated the sequence ID for the sequence of column 8.

| Duplex Name | Sense sequence name | Seq ID NO: (sense) | Sense sequence (5'-3') | Antisense sequence name | Seq ID NO: (anti sense) | Antisense sequence (5'-3') | mRNA target sequence in NM_001365536.1 | SEQ ID NO: (mRNA target) |
|---|---|---|---|---|---|---|---|---|
| AD-1251467.1 | A-1864159.1 | 4213 | usasuau(Uhd)uudAcdAacauccguuaL96 | A-2337737.1 | 4479 | VPusdAsacdGg(A2p)uguudGudAadAauauasusc | GAUAUAUUUACAACAUCCGUUA | 4745 |
| AD-1251466.1 | A-2337736.1 | 4214 | usasuau(Uhd)UfudAcdAacauccguuaL96 | A-2337737.1 | 4480 | VPusdAsacdGg(A2p)uguudGudAadAauauasusc | GAUAUAUUUACAACAUCCGUUA | 4746 |
| AD-1251470.1 | A-1535073.1 | 4215 | asusauu(Uhd)UfaCfAfAfcauccguuaaL96 | A-2337740.1 | 4481 | VPusUfsaadCgdGauguugUfaAfaauausgsu | AUAUAUUUACAACAUCCGUUAU | 4747 |
| AD-1251471.1 | A-2337741.1 | 4216 | asusauu(Uhd)UfaCfadAcauccguuaaL96 | A-2337742.1 | 4482 | VPuUfaadCgdGaugudTgUfadAaauausgsu | AUAUAUUUACAACAUCCGUUAU | 4748 |
| AD-1251465.1 | A-2337733.1 | 4217 | usasu(Uhd)UfuAfCfAfacauccguuaL96 | A-2337735.1 | 4483 | VPusAfsacdGg(A2p)uguuguAfaAfauasusg | UAUAUUUACAACAUCCGUUA | 4749 |
| AD-1251472.1 | A-2337743.1 | 4218 | usasuuu(Uhd)acdAaCfauccguuauaL96 | A-2337744.1 | 4484 | VPudAuadAcdGgaugdTudGudAaaauasusg | UAUAUUUACAACAUCCGUUAUU | 4750 |
| AD-1251464.1 | A-2337733.1 | 4219 | usasu(Uhd)UfuAfCfAfacauccguuaL96 | A-2337734.1 | 4485 | VPusAfsacdGg(Agn)uguuguAfaAfauasusg | UAUAUUUACAACAUCCGUUA | 4751 |
| AD-1251473.1 | A-2337745.1 | 4220 | asusuuuaCfaAfCfAfuccg(Uhd)uauuaL96 | A-2337746.1 | 4486 | VPusAfsaudAadCggauguUfgUfaaaausgsu | AUAUUUUACAACAUCCGUUAUUA | 4752 |
| AD-1251474.1 | A-2337747.1 | 4221 | asusuuuacadAcdAuccg(Uhd)uauuaL96 | A-2337748.1 | 4487 | VPudAaudAadCggaudGuUfgUfaaaausgsu | AUAUUUUACAACAUCCGUUAUUA | 4753 |
| AD-1251475.1 | A-2337749.1 | 4222 | ususuua(Chd)aaCfaUfccguuauuaaL96 | A-2337750.1 | 4488 | VPuUfaadTadAcggadTgUfudGuaaaasusg | UAUUUUACAACAUCCGUUAUUAC | 4754 |
| AD-1251476.1 | A-2337751.1 | 4223 | ususua(Chd)aacaUfCfcguuauuacaL96 | A-2337752.1 | 4489 | VPudGuadAudAacggdAudGuUfguaaasgsu | AUUUUACAACAUCCGUUAUUACU | 4755 |
| AD-1251279.1 | A-2337459.1 | 4224 | csasaca(Chd)aaUfUfUfcuucuuagcaL96 | A-2337464.1 | 4490 | VPudGcudAadGaagadAaUfudGuguugsusu | AACAACACAAUUUCUUCUUAGCA | 4756 |
| AD-1251276.1 | A-2337459.1 | 4225 | csasaca(Chd)aaUfUfUfcuucuuagcaL96 | A-2337460.1 | 4491 | VPusdGscudAadGaagadAaUfudGuguugsUSU | AACAACACAAUUUCUUCUUAGCA | 4757 |
| AD-1251280.1 | A-2337459.1 | 4226 | csasaca(Chd)aaUfUfUfcuucuuagcaL96 | A-2337465.1 | 4492 | VPudGcudAadGaagadAaUfudGuguugscsc | AACAACACAAUUUCUUCUUAGCA | 4758 |
| AD-1251277.1 | A-2337459.1 | 4227 | csasaca(Chd)aaUfUfUfcuucuuagcaL96 | A-2337461.1 | 4493 | VPusdGscudAadGaagadAaUfudGuguugsCSC | AACAACACAAUUUCUUCUUAGCA | 4759 |

TABLE 13A-continued

Exemplary Human SCN9A siRNA Modified Single Strands and Duplex Sequences
Column 1 indicates duplex name and the number following the decimal point in a duplex name merely refers to a batch production number. Column 2 indicates the name of the sense sequence. Column 3 indicates the sequence ID for the sequence of column 4. Column 4 provides the modified sequence of a sense strand suitable for use in a duplex described herein. Column 5 indicates the antisense sequence name. Column 6 indicates the sequence ID for the sequence of column 7. Column 7 provides the sequence of a modified antisense strand suitable for use in a duplex described herein, e.g., a duplex comprising the sense sequence in the same row of the table. Column 8 indicates the position in the target mRNA (NM_001365536.1) that is complementary to the antisense strand of Column 7. Column 9 indicated the sequence ID for the sequence of column 8.

| Duplex Name | Sense sequence name | Seq ID NO: (sense) | Sense sequence (5'-3') | Antisense sequence name | Seq ID NO: (anti sense) | Antisense sequence (5'-3') | mRNA target sequence in NM_00136 5536.1 | SEQ ID NO: (mRNA target) |
|---|---|---|---|---|---|---|---|---|
| AD-961334.3 | A-1812904.1 | 4228 | csasaca(Chd)aadTudTcuucuuagcaL96 | A-1812905.1 | 4494 | VPusdGscudAadGaagadAadTudGuguugsUSU | AACAACACAAUUUCUUCUUAGCA | 4760 |
| AD-1251278.1 | A-2337462.1 | 4229 | ascsacaaUfUfUfcuuc(Uhd)uagcaL96 | A-2337463.1 | 4495 | VPusdGscudAadGaagadAaUfudGugususg | CAACACAAUUUCUUCUUAGCA | 4761 |
| AD-1251477.1 | A-1865763.1 | 4230 | gsgscuu(Chd)aadGudGuuccuacugaL96 | A-2337753.1 | 4496 | VPuCfagdTadGgaacdAcUfudGaagccsgsg | CUGGCUUCAAGUGUUCCUACUGU | 4762 |
| AD-1251478.1 | A-2337754.1 | 4231 | gscsuu(Chd)aagUfgUfuccuacuguaL96 | A-2337755.1 | 4497 | VPudAcadGu(Agn)ggaadCaCfuUfgaagcscsg | UGGCUUCAAGUGUUCCUACUGUC | 4763 |
| AD-1251479.1 | A-2337756.1 | 4232 | csusucaagugUfUfccua(Chd)ugucaL96 | A-2337757.1 | 4498 | VPusdGsacdAg(Tgn)aggaacAfcUfugaagscsc | GGCUUCAAGUGUUCCUACUGUCA | 4764 |
| AD-1251481.1 | A-2337758.1 | 4233 |ususcaagUfgUfUfCfcuac(Uhd)gucaaL96 | A-2337760.1 | 4499 | VPuUfgadCa(G2p)uaggaaCfaCfuugaasgsc | GCUUCAAGUGUUCCUACUGUCAU | 4765 |
| AD-1251480.1 | A-2337758.1 | 4234 | ususcaagUfgUfUfCfcuac(Uhd)gucaaL96 | A-2337759.1 | 4500 | VPusUfsgadCa(G2p)uaggaaCfaCfuugaasgsc | GCUUCAAGUGUUCCUACUGUCAU | 4766 |
| AD-1251482.1 | A-2337761.1 | 4235 | uscsaag(Uhd)guUfCfCfuacugucauaL96 | A-2337762.1 | 4501 | VPusAfsugdAc(Agn)guaggaAfcAfcuugasgsg | CUUCAAGUGUUCCUACUGUCAUG | 4767 |
| AD-1251483.1 | A-2337761.1 | 4236 | uscsaag(Uhd)guUfCfCfuacugucauaL96 | A-2337763.1 | 4502 | VPusdAsugdAc(A2p)guagdGadAcdAcuugasgsg | CUUCAAGUGUUCCUACUGUCAUG | 4768 |
| AD-1251492.1 | A-2337764.1 | 4237 | csasagugUfuCfCfUfacug(Uhd)caugaL96 | A-2337773.1 | 4503 | VPuCfaudGa(C2p)aguaggAfaCfacuugscsc | UUCAAGUGUUCCUACUGUCAUGA | 4769 |
| AD-1251485.1 | A-2337764.1 | 4238 | csasagugUfuCfCfUfacug(Uhd)caugaL96 | A-2337766.1 | 4504 | VPusCfsaudGadCaguadGgdAaCfacuugsgsg | UUCAAGUGUUCCUACUGUCAUGA | 4770 |
| AD-802471.4 | A-1536717.1 | 4239 | csasagu(Ghd)UfuCfCfUfacugucaugaL96 | A-1536718.1 | 4505 | VPusCfsaugAfcAfGfuaggAfaCfacuugsasa | UUCAAGUGUUCCUACUGUCAUGA | 4771 |
| AD-1251486.1 | A-2337764.1 | 4240 | csasagugUfuCfCfUfacug(Uhd)caugaL96 | A-1536718.1 | 4506 | VPusCfsaugAfcAfGfuaggAfaCfacuugsasa | UUCAAGUGUUCCUACUGUCAUGA | 4772 |
| AD-1251484.1 | A-2337764.1 | 4241 | csasagugUfuCfCfUfacug(Uhd)caugaL96 | A-2337765.1 | 4507 | VPusCfsaudGadCaguaggAfaCfacuugsgsg | UUCAAGUGUUCCUACUGUCAUGA | 4773 |
| AD-1251491.1 | A-2337764.1 | 4242 | csasagugUfuCfCfUfacug(Uhd)caugaL96 | A-2337772.1 | 4508 | VPuCfaudGa(C2p)aguaggAfaCfacuugsgsg | UUCAAGUGUUCCUACUGUCAUGA | 4774 |

TABLE 13A-continued

Exemplary Human SCN9A siRNA Modified Single Strands and Duplex Sequences
Column 1 indicates duplex name and the number following the decimal point in a duplex name merely refers to a batch production number. Column 2 indicates the name of the sense sequence. Column 3 indicates the sequence ID for the sequence of column 4. Column 4 provides the modified sequence of a sense strand suitable for use in a duplex described herein. Column 5 indicates the antisense sequence name. Column 6 indicates the sequence ID for the sequence of column 7. Column 7 provides the sequence of a modified antisense strand suitable for use in a duplex described herein, e.g., a duplex comprising the sense sequence in the same row of the table. Column 8 indicates the position in the target mRNA (NM_001365536.1) that is complementary to the antisense strand of Column 7. Column 9 indicated the sequence ID for the sequence of column 8.

| Duplex Name | Sense sequence name | Seq ID NO: (sense) | Sense sequence (5'-3') | Antisense sequence name | Seq ID NO: (anti sense) | Antisense sequence (5'-3') | mRNA target sequence in NM_001365536.1 | SEQ ID NO: (mRNA target) |
|---|---|---|---|---|---|---|---|---|
| AD-1251487.1 | A-2337764.1 | 4243 | csasagugUfuCfCfUfacug(Uhd)caugaL96 | A-2337767.1 | 4509 | VPusCfsaudGa(C2p)aguaggAfaCfacuugsgsg | UUCAAGUGUUCCUACUGUCAUGA | 4775 |
| AD-1251488.1 | A-2337764.1 | 4244 | csasagugUfuCfCfUfacug(Uhd)caugaL96 | A-2337768.1 | 4510 | VPusCfsaudGa(C2p)aguaggAfaCfacuugscsc | UUCAAGUGUUCCUACUGUCAUGA | 4776 |
| AD-1251490.1 | A-2337764.1 | 4245 | csasagugUfuCfCfUfacug(Uhd)caugaL96 | A-2337771.1 | 4511 | VPusCfsaudGa(C2p)aguadGgdAaCfacuugsgsg | UUCAAGUGUUCCUACUGUCAUGA | 4777 |
| AD-1251494.1 | A-2337775.1 | 4246 | asasgug(Uhd)UfcCfudAcugucaugaaL96 | A-2337776.1 | 4512 | VPuUfcadTg(A2p)cagudAgdGadAcacuusgsg | UCAAGUGUUCCUACUGUCAUGAC | 4778 |
| AD-1251493.1 | A-2337769.1 | 4247 | asgsugUfuCfCfUfacug(Uhd)caugaL96 | A-2337774.1 | 4513 | VPuCfaudGa(C2p)aguaggAfaCfacususg | CAAGUGUUCCUACUGUCAUGA | 4779 |
| AD-1251489.1 | A-2337769.1 | 4248 | asgsugUfuCfCfUfacug(Uhd)caugaL96 | A-2337770.1 | 4514 | VPusCfsaudGa(C2p)aguaggAfaCfacususg | CAAGUGUUCCUACUGUCAUGA | 4780 |
| AD-1251495.1 | A-2337777.1 | 4249 | asgsugu(Uhd)CfcUfaCfugucaugacaL96 | A-2337778.1 | 4515 | VPudGucdAu(G2p)acagdTadGgdAacacususg | CAAGUGUUCCUACUGUCAUGACC | 4781 |
| AD-1251496.1 | A-2337779.1 | 4250 | gsusguu(Chd)CfuaCfUfgucaugaccaL96 | A-2337780.1 | 4516 | VPudGgudCa(Tgn)gacaguAfgdGaacacsusu | AAGUGUUCCUACUGUCAUGACCU | 4782 |
| AD-1251497.1 | A-2337781.1 | 4251 | usgsuuc(Chd)UfaCfudGUfcaugaccuaL96 | A-2337782.1 | 4517 | VPudAggdTc(Agn)ugacdAgUfadGgaacascSU | AGUGUUCCUACUGUCAUGACCUG | 4783 |
| AD-1251498.1 | A-2337783.1 | 4252 | gsusucc(Uhd)acUfgUfcaugaccugaL96 | A-2337784.1 | 4518 | VPuCfagdGu(C2p)augadCadGudAggaacsgsc | GUGUUCCUACUGUCAUGACCUGC | 4784 |
| AD-802552.3 | A-1536877.1 | 4253 | ususgau(Ahd)GfuUfAfCfcuaguuugcaL96 | A-1536878.1 | 4519 | VPusGfscaaAfcUfAfgguaAfcUfaucaasasa | UUUUGAUAGUUACCUAGUUUGCA | 4785 |
| AD-1251267.1 | A-2337439.1 | 4254 | ususgauagudTadCcuag(Uhd)uugcaL96 | A-2337448.1 | 4520 | VPudGcadAadCuaggdTadAcUfaucaasgsg | UUUUGAUAGUUACCUAGUUUGCA | 4786 |
| AD-1251260.1 | A-2337439.1 | 4255 | ususgauagudTadCcuag(Uhd)uugcaL96 | A-2337438.1 | 4521 | VPusdGscadAadCuaggdTadAcUfaucaasgsg | UUUUGAUAGUUACCUAGUUUGCA | 4787 |
| AD-1251256.1 | A-2337433.1 | 4256 | ususgauaGfuUfAfCfcuag(Uhd)uugcaL96 | A-1536878.1 | 4522 | VPusGfscaaAfcUfAfgguaAfcUfaucaasasa | UUUUGAUAGUUACCUAGUUUGCA | 4788 |
| AD-1251265.1 | A-2337436.1 | 4257 | ususgauaguUfAfCfcuag(Uhd)uugcaL96 | A-2337447.1 | 4523 | VPudGcadAadCuagguaAfcUfaucaasgsg | UUUUGAUAGUUACCUAGUUUGCA | 4789 |

TABLE 13A-continued

Exemplary Human SCN9A siRNA Modified Single Strands and Duplex Sequences
Column 1 indicates duplex name and the number following the decimal point in a duplex name merely refers to a batch production number. Column 2 indicates the name of the sense sequence. Column 3 indicates the sequence ID for the sequence of column 4. Column 4 provides the modified sequence of a sense strand suitable for use in a duplex described herein. Column 5 indicates the antisense sequence name. Column 6 indicates the sequence ID for the sequence of column 7. Column 7 provides the sequence of a modified antisense strand suitable for use in a duplex described herein, e.g., a duplex comprising the sense sequence in the same row of the table. Column 8 indicates the position in the target mRNA (NM_001365536.1) that is complementary to the antisense strand of Column 7. Column 9 indicated the sequence ID for the sequence of column 8.

| Duplex Name | Sense sequence name | Seq ID NO: (sense) | Sense sequence (5'-3') | Antisense sequence name | Seq ID NO: (anti sense) | Antisense sequence (5'-3') | mRNA target sequence in NM_001365536.1 | SEQ ID NO: (mRNA target) |
|---|---|---|---|---|---|---|---|---|
| AD-1251257.1 | A-2337434.1 | 4258 | ususgau(Ahd)guUfAfCfcuaguuugcaL96 | A-2337435.1 | 4524 | VPusdGscadAadCuagguaAfcUfaucaasgsg | UUUUGAUAGUUACCUAGUUUGCA | 4790 |
| AD-1251266.1 | A-2337437.1 | 4259 | ususgauaguUfaCfcuag(Uhd)uugcaL96 | A-2337448.1 | 4525 | VPudGcadAadCuaggdTadAcUfaucaasgsg | UUUUGAUAGUUACCUAGUUUGCA | 4791 |
| AD-1251264.1 | A-2337445.1 | 4260 | ususgauaguUfAfCfcuaa(Uhd)uugcaL96 | A-2337446.1 | 4526 | VPusdGscadAadTuagguaAfcUfaucaasgsg | | |
| AD-1251259.1 | A-2337437.1 | 4261 | ususgauaguUfaCfcuag(Uhd)uugcaL96 | A-2337438.1 | 4527 | VPusdGscadAadCuaggdTadAcUfaucaasgsg | UUUUGAUAGUUACCUAGUUUGCA | 4793 |
| AD-1251258.1 | A-2337436.1 | 4262 | ususgauaguUfAfCfcuag(Uhd)uugcaL96 | A-2337435.1 | 4528 | VPusdGscadAadCuagguaAfcUfaucaasgsg | UUUUGAUAGUUACCUAGUUUGCA | 4794 |
| AD-1251263.1 | A-2337444.1 | 4263 | gsasuagudTadCcuag(Uhd)uugcaL96 | A-2337443.1 | 4529 | VPusdGscadAadCuaggdTadAcUfaucsgsg | UUGAUAGUUACCUAGUUUGCA | 4795 |
| AD-1251262.1 | A-2337442.1 | 4264 | gsasuaguUfaCfcuag(Uhd)uugcaL96 | A-2337443.1 | 4530 | VPusdGscadAadCuaggdTadAcUfaucsgsg | UUGAUAGUUACCUAGUUUGCA | 4796 |
| AD-1251261.1 | A-2337440.1 | 4265 | gsasuaguUfAfCfcuag(Uhd)uugcaL96 | A-2337441.1 | 4531 | VPusdGscadAadCuagguaAfcUfaucsgsg | UUGAUAGUUACCUAGUUUGCA | 4797 |

TABLE 13B

Exemplary Human SCN9A Unmodified Single Strands and Duplex Sequences.
Column 1 indicates duplex name; the number following the decimal point in a duplex name merely refers to a batch production number. Column 2 indicates the sense sequence name. Column 3 indicates the sequence ID for the sequence of column 4. Column 4 provides the unmodified sequence of a sense strand suitable for use in a duplex described herein. Column 5 provides the position in the target mRNA (NM_001365536.1) of the sense strand of Column 4. Column 6 indicates the antisense sequence name. Column 7 indicates the sequence ID for the sequence of column 8. Column 8 provides the sequence of an antisense strand suitable for use in a duplex described herein, without specifying chemical modifications. Column 9 indicates the position in the target mRNA (NM_001365536.1) that is complementary to the antisense strand of Column 8.

| Duplex Name | Sense sequence name | Seq ID NO: (sense) | Sense sequence (5'-3') | mRNA target range in NM_001365536.1 | Antisense sequence name | Seq ID NO: (antisense) | antisense sequence (5'-3') | mRNA target range in NM_001365536.1 |
|---|---|---|---|---|---|---|---|---|
| AD-1251302.1 | A-2337487.1 | 4798 | ACACAAAGGGAAAACAAUCUA | 571-591 | A-2337488.1 | 5064 | UAGATUGUUUUCCCUUUGUGUUC | |
| AD-1251303.1 | A-2337489.1 | 4799 | CACAAAGGGAAAACAAUCUUA | 572-592 | A-2337490.1 | 5065 | UAAGAUTGUUUUCCCUUUGUGUU | |
| AD-1251304.1 | A-2337491.1 | 4800 | ACAAAGGGAAAACAAUCUUCA | 573-593 | A-2337492.1 | 5066 | UGAAGATUGUUUUCCCUUUGUGU | 571-593 |
| AD-1251305.1 | A-2337493.1 | 4801 | CAAAGGGAAAACAAUCUUCCA | 574-594 | A-2337494.1 | 5067 | UGGAAGAUUGUUUUCCCUUUGUG | 572-594 |
| AD-1251306.1 | A-2337495.1 | 4802 | AAAGGGAAAACAAUCUUCCGA | 575-595 | A-2337496.1 | 5068 | UCGGAAGAUUGUUUUCCCUUUGU | 573-595 |
| AD-1251307.1 | A-2337497.1 | 4803 | AAAGGGAAAACAAUCUUCCGA | 575-595 | A-2337498.1 | 5069 | UCGGAAGAUUGTUUUCCCUUUGU | 573-595 |
| AD-1251315.1 | A-2337506.1 | 4804 | AAGGGAAAACAAUCUUCCGUA | 576-596 | A-2337501.1 | 5070 | UACGGAAGAUUGUUUTCCCUUUG | 574-596 |
| AD-1251310.1 | A-2337499.1 | 4805 | AAGGGAAAACAAUCUUCCGUA | 576-596 | A-2337501.1 | 5071 | UACGGAAGAUUGUUUTCCCUUUG | 574-596 |
| AD-961179.3 | A-1812594.1 | 4806 | AAGGGAAAACAAUCUUCCGUA | 576-596 | A-1812595.1 | 5072 | UACGGAAGAUUGUTUTCCCUUUG | 574-596 |
| AD-1251308.1 | A-2337499.1 | 4807 | AAGGGAAAACAAUCUUCCGUA | 576-596 | A-1812595.1 | 5073 | UACGGAAGAUUGUTUTCCCUUUG | 574-596 |
| AD-1251314.1 | A-2337506.1 | 4808 | AAGGGAAAACAAUCUUCCGUA | 576-596 | A-2337500.1 | 5074 | UACGGAAGAUUGUUUTCCCUUUG | 574-596 |
| AD-1251309.2 | A-2337499.1 | 4809 | AAGGGAAAACAAUCUUCCGUA | 576-596 | A-2337500.1 | 5075 | UACGGAAGAUUGUUUTCCCUUUG | 574-596 |
| AD-1251316.1 | A-2337506.1 | 4810 | AAGGGAAAACAAUCUUCCGUA | 576-596 | A-2337507.1 | 5076 | UACGGAAGAUUGUUUTCCCUUUG | 574-596 |

TABLE 13B-continued

Exemplary Human SCN9A Unmodified Single Strands and Duplex Sequences. Column 1 indicates duplex name; the number following the decimal point in a duplex name merely refers to a batch production number. Column 2 indicates the sense sequence name. Column 3 indicates the sequence ID for the sequence of column 4. Column 4 provides the unmodified sequence of a sense strand suitable for use in a duplex described herein. Column 5 provides the position in the target mRNA (NM_001365536.1) of the sense strand of Column 4. Column 6 indicates the antisense sequence name. Column 7 indicates the sequence ID for the sequence of column 8. Column 8 provides the sequence of an antisense strand suitable for use in a duplex described herein, without specifying chemical modifications. Column 9 indicates the position in the target mRNA (NM_001365536.1) that is complementary to the antisense strand of Column 8.

| Duplex Name | Sense sequence name | Seq ID NO: (sense) | Sense sequence (5'-3') | mRNA target range in NM_001365536.1 | Antisense sequence name | Seq ID NO: (antisense) | antisense sequence (5'-3') | mRNA target range in NM_001365536.1 |
|---|---|---|---|---|---|---|---|---|
| AD-1251317.1 | A-2337506.1 | 4811 | AAGGGAAAACAAUCUUCCGUA | 576-596 | A-2337508.1 | 5077 | UACGGAAGAUUGUUUCCCUUUG | 574-596 |
| AD-1251311.1 | A-2337499.1 | 4812 | AAGGGAAAACAAUCUUCCGUA | 576-596 | A-2337502.1 | 5078 | UACGGAAGAUUGUUUCCCUUCC | 574-596 |
| AD-1251309.1 | A-2337499.1 | 4813 | AAGGGAAAACAAUCUUCCGUA | 576-596 | A-2337500.1 | 5079 | UACGGAAGAUUGUUUCCCUUUG | 574-596 |
| AD-1251318.1 | A-2337509.1 | 4814 | AGGGAAAACAAUCUUCCGUUA | 577-597 | A-2337510.1 | 5080 | UAACGGAAGAUUGUUUUCCCUUU | 575-597 |
| AD-1251319.1 | A-2337511.1 | 4815 | AGGGAAAACAAUCUUCCGUUA | 577-597 | A-2337512.1 | 5081 | UAACGGAAGAUTGUUUUCCCUUU | 575-597 |
| AD-1251313.1 | A-2337503.1 | 4816 | GGGAAAACAAUCUUCCGUA | 578-596 | A-2337505.1 | 5082 | UACGGAAGAUUGUUUCCCUU | 576-596 |
| AD-1251312.1 | A-2337503.1 | 4817 | GGGAAAACAAUCUUCCGUA | 578-596 | A-2337504.1 | 5083 | UACGGAAGAUUGUUUCCCUU | 576-596 |
| AD-1251320.1 | A-2337513.1 | 4818 | GGGAAAACAAUCUUCCGUUUA | 578-598 | A-2337514.1 | 5084 | UAAACGGAAGATUGUUUUCCCUU | 576-598 |
| AD-1251321.1 | A-2337515.1 | 4819 | GGAAAACAAUCUUCCGUUUCA | 579-599 | A-2337516.1 | 5085 | UGAAACGGAAGAUUGUUUUCCCU | 577-599 |
| AD-1251323.1 | A-2337519.1 | 4820 | GAAAACAAUCUUCCGUUUCAA | 580-600 | A-2337520.1 | 5086 | UUGAAACGGAAGAUUGUUUUCCC | 578-600 |
| AD-1251322.1 | A-2337517.1 | 4821 | GAAAACAAUCUUCCAUUUCAA | 580-600 | A-2337518.1 | 5087 | UUGAAATGGAAGAUUGUUUUCCC | 578-600 |
| AD-1251325.1 | A-2337523.1 | 4822 | AAAACAAUCUUCCGUUUCAAA | 581-601 | A-2337524.1 | 5088 | UUUGAAACGGAAGAUUGUUUUCC | 579-601 |
| AD-1251324.1 | A-2337521.1 | 4823 | AAAACAAUCUUCCGUUUCAAA | 581-601 | A-2337522.1 | 5089 | UUUGAAACGGAAGAUUGUUUUCC | 579-601 |

TABLE 13B-continued

Exemplary Human SCN9A Unmodified Single Strands and Duplex Sequences.
Column 1 indicates duplex name; the number following the decimal point in a duplex name merely refers to a batch production number. Column 2 indicates the sense sequence name. Column 3 indicates the sequence ID for the sequence of column 4. Column 4 provides the unmodified sequence of a sense strand suitable for use in a duplex described herein. Column 5 provides the position in the target mRNA (NM_001365536.1) of the sense strand of Column 4. Column 6 indicates the antisense sequence name. Column 7 indicates the sequence ID for the sequence of column 8. Column 8 provides the sequence of an antisense strand suitable for use in a duplex described herein, without specifying chemical modifications. Column 9 indicates the position in the target mRNA (NM_001365536.1) that is complementary to the antisense strand of Column 8.

| Duplex Name | Sense sequence name | Seq ID NO: (sense) | Sense sequence (5'-3') | mRNA target range in NM_001365536.1 | Antisense sequence name | Seq ID NO: (antisense) | antisense sequence (5'-3') | mRNA target range in NM_001365536.1 |
|---|---|---|---|---|---|---|---|---|
| AD-1251249.1 | A-2337423.1 | 4824 | UGUCGAGUACACUUUUACUGA | 760-780 | A-2337424.1 | 5090 | UCAGTAAAAGUGUACUCGACAUU | 758-780 |
| AD-1251254.1 | A-2337423.1 | 4825 | UGUCGAGUACACUUUUACUGA | 760-780 | A-2337431.1 | 5091 | UCAGTAAAAGUGUACUCGACACC | 758-780 |
| AD-1251248.1 | A-2337423.1 | 4826 | UGUCGAGUACACUUUUACUGA | 760-780 | A-1522698.1 | 5092 | UCAGUAAAAGUGUACUCGACAUU | 758-780 |
| AD-1251284.1 | A-2337423.1 | 4827 | UGUCGAGUACACUUUUACUGA | 760-780 | A-2337467.1 | 5093 | UCAGTAAAAGUGUACTCGACAUU | 758-780 |
| AD-1251253.1 | A-2337428.1 | 4828 | UGUCGAGUACACUUUUACUGA | 760-780 | A-2337430.1 | 5094 | UCAGTAAAAGUGUACUCGACACC | 758-780 |
| AD-1251286.1 | A-2337423.1 | 4829 | UGUCGAGUACACUUUUACUGA | 760-780 | A-2337469.1 | 5095 | UCAGTAAAAGUGUACTCGACACC | 758-780 |
| AD-1251282.1 | A-2337423.1 | 4830 | UGUCGAGUACACUUUUACUGA | 760-780 | A-1875199.1 | 5096 | UCAGTAAAAGUGUACTCGACAUU | 758-780 |
| AD-1010661.3 | A-1851664.1 | 4831 | UGUCGAGUACACUUUUACUGA | 803-823 | A-1875199.1 | 5097 | UCAGTAAAAGUGUACTCGACAUU | 801-823 |
| AD-795305.3 | A-1522697.1 | 4832 | UGUCGAGUACACUUUUACUGA | 760-780 | A-1522698.1 | 5098 | UCAGUAAAAGUGUACUCGACAUU | 758-780 |
| AD-1251250.1 | A-2337423.1 | 4833 | UGUCGAGUACACUUUUACUGA | 760-780 | A-2337425.1 | 5099 | UCAGTAAAAGUGUACUCGACACC | 758-780 |
| AD-1251283.1 | A-2337423.1 | 4834 | UGUCGAGUACACUUUUACUGA | 760-780 | A-2337466.1 | 5100 | UCAGTAAAAGUGUACTCGACAUU | 758-780 |
| AD-1251281.1 | A-2337428.1 | 4835 | UGUCGAGUACACUUUUACUGA | 760-780 | A-2337466.1 | 5101 | UCAGTAAAAGUGUACTCGACAUU | 758-780 |
| AD-1251255.1 | A-2337428.1 | 4836 | UGUCGAGUACACUUUUACUGA | 760-780 | A-2337432.1 | 5102 | UCAGTAAAAGUGUACUCGACACC | 758-780 |
| AD-1251289.1 | A-2337428.1 | 4837 | UGUCGAGUACACUUUUACUGA | 760-780 | A-2337473.1 | 5103 | UCAGTAAAAGUGUACTCGACAUU | 758-780 |

TABLE 13B-continued

Exemplary Human SCN9A Unmodified Single Strands and Duplex Sequences.
Column 1 indicates duplex name; the number following the decimal point in a duplex name merely refers to a batch production number. Column 2 indicates the sense sequence name. Column 3 indicates the sequence ID for the sequence of column 4. Column 4 provides the unmodified sequence of a sense strand suitable for use in a duplex described herein. Column 5 provides the position in the target mRNA (NM_001365536.1) of the sense strand of Column 4. Column 6 indicates the antisense sequence name. Column 7 indicates the sequence ID for the sequence of column 8. Column 8 provides the sequence of an antisense strand suitable for use in a duplex described herein, without specifying chemical modifications. Column 9 indicates the position in the target mRNA (NM_001365536.1) that is complementary to the antisense strand of Column 8.

| Duplex Name | Sense sequence name | Seq ID NO: (sense) | Sense sequence (5'-3') | mRNA target range in NM_001365536.1 | Antisense sequence name | Seq ID NO: (antisense) | antisense sequence (5'-3') | mRNA target range in NM_001365536.1 |
|---|---|---|---|---|---|---|---|---|
| AD-1251252.1 | A-2337428.1 | 4838 | UGUCGAGUACACUUUUACUGA | 760-780 | A-2337429.1 | 5104 | UCAGTAAAAGUGUACUCGACAUU | 758-780 |
| AD-1251285.1 | A-2337428.1 | 4839 | UGUCGAGUACACUUUUACUGA | 760-780 | A-2337468.1 | 5105 | UCAGTAAAAGUGUACTCGACACC | 758-780 |
| AD-1251291.1 | A-2337428.1 | 4840 | UGUCGAGUACACUUUUACUGA | 760-780 | A-2337475.1 | 5106 | UCAGTAAAAGUGUACTCGACACC | 758-780 |
| AD-1251290.1 | A-2337423.1 | 4841 | UGUCGAGUACACUUUUACUGA | 760-780 | A-2337474.1 | 5107 | UCAGTAAAAGUGUACTCGACAUU | 758-780 |
| AD-1251251.1 | A-2337426.1 | 4842 | UCGAGUACACUUUUACUGA | 762-780 | A-2337427.1 | 5108 | UCAGTAAAAGUGUACUCGACG | 760-780 |
| AD-1251287.1 | A-2337470.1 | 4843 | UCGAGUACACUUUUACUGA | 762-780 | A-2337471.1 | 5109 | UCAGTAAAAGUGUACTCGACG | 760-780 |
| AD-1251288.1 | A-2337426.1 | 4844 | UCGAGUACACUUUUACUGA | 762-780 | A-2337472.1 | 5110 | UCAGTAAAAGUGUACTCGACG | 760-780 |
| AD-1251326.1 | A-2337525.1 | 4845 | GAGGCUUCUGUGUAGGAGAAA | 819-839 | A-2337526.1 | 5111 | UUUCTCCUACACAGAAGCCUCUU | 817-839 |
| AD-1251327.1 | A-1851778.1 | 4846 | AGGCUUCUGUGUAGGAGAAUA | 863-883 | A-2337527.1 | 5112 | UAUUCUCCUACACAGAAGCCUCU | 861-883 |
| AD-1251328.1 | A-2337528.1 | 4847 | GGCUUCUGUGUAGGAGAAUUA | 821-841 | A-2337529.1 | 5113 | UAAUTCTCCUACACAGAAGCCUC | 819-841 |
| AD-1251329.1 | A-2337530.1 | 4848 | GCUUCUGUGUAGGAGAAUUCA | 822-842 | A-2337531.1 | 5114 | UGAATUCUCCUACACAGAAGCCU | 820-842 |
| AD-1251330.1 | A-2337532.1 | 4849 | CUUCUGUGTAGGAGAAUUCAA | 823-843 | A-2337533.1 | 5115 | UUGAAUTCUCCTACACAGAAGCC | 821-843 |
| AD-795366.3 | A-1522818.1 | 4850 | UUCUGUGUAGGAGAAUUCACA | 824-844 | A-1522819.1 | 5116 | UGUGAAUUCUCCUACACAGAAGC | 822-844 |

TABLE 13B-continued

Exemplary Human SCN9A Unmodified Single Strands and Duplex Sequences.
Column 1 indicates duplex name; the number following the decimal point in a duplex name merely refers to a batch production number. Column 2 indicates the sense sequence name. Column 3 indicates the sequence ID for the sequence of column 4. Column 4 provides the unmodified sequence of a sense strand suitable for use in a duplex described herein. Column 5 provides the position in the target mRNA (NM_001365536.1) of the sense strand of Column 4. Column 6 indicates the antisense sequence name. Column 7 indicates the sequence ID for the sequence of column 8. Column 8 provides the sequence of an antisense strand suitable for use in a duplex described herein, without specifying chemical modifications. Column 9 indicates the position in the target mRNA (NM_001365536.1) that is complementary to the antisense strand of Column 8.

| Duplex Name | Sense sequence name | Seq ID NO: (sense) | Sense sequence (5'-3') | mRNA target range in NM_001365536.1 | Antisense sequence name | Seq ID NO: (antisense) | antisense sequence (5'-3') | mRNA target range in NM_001365536.1 |
|---|---|---|---|---|---|---|---|---|
| AD-1251331.1 | A-1522818.1 | 4851 | UUCUGUGUAGGAGAAUUCACA | 824-844 | A-2337534.1 | 5117 | UGUGAATUCUCCUACACAGAAGC | 822-844 |
| AD-1251334.1 | A-2337536.1 | 4852 | UUCUGUGUAGGAGAAUUCACA | 824-844 | A-2337538.1 | 5118 | UGUGAAUUCUCCUACACAGAAGC | 822-844 |
| AD-1251333.1 | A-2337536.1 | 4853 | UUCUGUGUAGGAGAAUUCACA | 824-844 | A-2337537.1 | 5119 | UGUGAATUCUCCUACACAGAAGC | 822-844 |
| AD-1251338.1 | A-1851786.1 | 4854 | UUCUGUGUAGGAGAAUUCACA | 867-887 | A-2337542.1 | 5120 | UGUGAAUUCUCCUACACAGAAGC | 865-887 |
| AD-1251337.1 | A-1851786.1 | 4855 | UUCUGUGUAGGAGAAUUCACA | 867-887 | A-2337541.1 | 5121 | UGUGAATUCUCCUACACAGAAGC | 865-887 |
| AD-1251336.1 | A-2337536.1 | 4856 | UUCUGUGUAGGAGAAUUCACA | 824-844 | A-2337540.1 | 5122 | UGUGAAUUCUCCUACACAGAAUC | 822-844 |
| AD-1251335.1 | A-2337536.1 | 4857 | UUCUGUGUAGGAGAAUUCACA | 824-844 | A-2337539.1 | 5123 | UGUGAATUCUCCUACACAGAAUC | 822-844 |
| AD-1251339.1 | A-2337543.1 | 4858 | UCUGUGUAGGAGAAUUCACUA | 825-845 | A-2337544.1 | 5124 | UAGUGAAUUCUCCUACACAGAGG | 823-845 |
| AD-1251340.1 | A-1851790.1 | 4859 | CUGUGUAGGAGAAUUCACUUA | 869-889 | A-2337545.1 | 5125 | UAAGTGAAUUCTCCUACACAGGG | 867-889 |
| AD-1251341.1 | A-2337546.1 | 4860 | UGUGUAGGAGAAUUCACUUUA | 827-847 | A-2337547.1 | 5126 | UAAAGUGAAUUCUCCUACACAGG | 825-847 |
| AD-1251342.1 | A-2337548.1 | 4861 | GUGUAGGAGAAUUCACUUUUA | 828-848 | A-2337549.1 | 5127 | UAAAAGTGAAUTCUCCUACACGG | 826-848 |
| AD-1251347.1 | A-2337481.1 | 4862 | UGUAGGAGAAUUCACUUUUCA | 829-849 | A-2337555.1 | 5128 | UGAAAAGUGAATUCUCCUACACG | 827-849 |
| AD-795371.3 | A-1522828.1 | 4863 | UGUAGGAGAAUUCACUUUUCA | 829-849 | A-1522829.1 | 5129 | UGAAAAGUGAAUUCUCCUACACA | 827-849 |
| AD-1010663.3 | A-1851796.1 | 4864 | UGUAGGAGAATUCACUUUUCA | 872-892 | A-1875201.1 | 5130 | UGAAAAGUGAATUCUCCUACACA | 870-892 |

TABLE 13B-continued

Exemplary Human SCN9A Unmodified Single Strands and Duplex Sequences.
Column 1 indicates duplex name; the number following the decimal point in a duplex name merely refers to a batch production number. Column 2 indicates the sense sequence name. Column 3 indicates the sequence ID for the sequence of column 4. Column 4 provides the unmodified sequence of a sense strand suitable for use in a duplex described herein. Column 5 provides the position in the target mRNA (NM_001365536.1) of the sense strand of Column 4. Column 6 indicates the antisense sequence name. Column 7 indicates the sequence ID for the sequence of column 8. Column 8 provides the sequence of an antisense strand suitable for use in a duplex described herein, without specifying chemical modifications. Column 9 indicates the position in the target mRNA (NM_001365536.1) that is complementary to the antisense strand of Column 8.

| Duplex Name | Sense sequence name | Seq ID NO: (sense) | Sense sequence (5'-3') | mRNA target range in NM_001365536.1 | Antisense sequence name | Seq ID NO: (antisense) | antisense sequence (5'-3') | mRNA target range in NM_001365536.1 |
|---|---|---|---|---|---|---|---|---|
| AD-1251301.1 | A-2337482.1 | 4865 | UGUAGGAGAAUUCACUUUUCA | 829-849 | A-2337486.1 | 5131 | UGAAAAGUGAAUUCUCCUACACG | 827-849 |
| AD-1251348.1 | A-2337556.1 | 4866 | UGUAGGAGAAUUCAUUUUUCA | 829-849 | A-2337557.1 | 5132 | UGAAAAAUGAAUUCUCCUACACG | 827-849 |
| AD-1251343.1 | A-2337550.1 | 4867 | UGUAGGAGAAUUCACUUUUCA | 829-849 | A-1522829.1 | 5133 | UGAAAAGUGAAUUCUCCUACACA | 827-849 |
| AD-1251346.1 | A-2337550.1 | 4868 | UGUAGGAGAAUUCACUUUUCA | 829-849 | A-2337554.1 | 5134 | UGAAAAGUGAAUUCUCCUACG | 829-849 |
| AD-1251299.1 | A-2337476.1 | 4869 | UGUAGGAGAATUCACUUUUCA | 829-849 | A-2337486.1 | 5135 | UGAAAAGUGAAUUCUCCUACACG | 827-849 |
| AD-1251345.1 | A-2337552.1 | 4870 | UGUAGGAGAAUUCAUUUUUCA | 829-849 | A-2337553.1 | 5136 | UGAAAAAUGAAUUCUCCUACACG | 827-849 |
| AD-1251349.1 | A-2337481.1 | 4871 | UGUAGGAGAAUUCACUUUUCA | 829-849 | A-2337558.1 | 5137 | UGAAAAGUGAATUCUCCUACACG | 827-849 |
| AD-1251292.1 | A-2337476.1 | 4872 | UGUAGGAGAATUCACUUUUCA | 829-849 | A-2337477.1 | 5138 | UGAAAAGUGAATUCUCCUACACG | 827-849 |
| AD-1251293.1 | A-2337476.1 | 4873 | UGUAGGAGAATUCACUUUUCA | 829-849 | A-2337478.1 | 5139 | UGAAAAGUGAATUCUCCUACACG | 827-849 |
| AD-1251294.1 | A-2337479.1 | 4874 | UGUAGGAGAATUCAUUUUUCA | 829-849 | A-2337480.1 | 5140 | UGAAAAAUGAATUCUCCUACACG | 827-849 |
| AD-1251344.1 | A-2337550.1 | 4875 | UGUAGGAGAAUUCACUUUUCA | 829-849 | A-2337551.1 | 5141 | UGAAAAGUGAAUUCUCCUACACG | 827-849 |
| AD-1251300.1 | A-2337481.1 | 4876 | UGUAGGAGAAUUCACUUUUCA | 829-849 | A-2337486.1 | 5142 | UGAAAAGUGAATUCUCCUACACG | 827-849 |
| AD-1251295.1 | A-2337481.1 | 4877 | UGUAGGAGAAUUCACUUUUCA | 829-849 | A-2337478.1 | 5143 | UGAAAAGUGAATUCUCCUACACG | 827-849 |

TABLE 13B-continued

Exemplary Human SCN9A Unmodified Single Strands and Duplex Sequences.
Column 1 indicates duplex name; the number following the decimal point in a duplex name merely refers to a batch production number. Column 2 indicates the sense sequence name. Column 3 indicates the sequence ID for the sequence of column 4. Column 4 provides the unmodified sequence of a sense strand suitable for use in a duplex described herein. Column 5 provides the position in the target mRNA (NM_001365536.1) of the sense strand of Column 4. Column 6 indicates the antisense sequence name. Column 7 indicates the sequence ID for the sequence of column 8. Column 8 provides the sequence of an antisense strand suitable for use in a duplex described herein, without specifying chemical modifications. Column 9 indicates the position in the target mRNA (NM_001365536.1) that is complementary to the antisense strand of Column 8.

| Duplex Name | Sense sequence name | Seq ID NO: (sense) | Sense sequence (5'-3') | mRNA target range in NM_001365536.1 | Antisense sequence name | Seq ID NO: (antisense) | antisense sequence (5'-3') | mRNA target range in NM_001365536.1 |
|---|---|---|---|---|---|---|---|---|
| AD-1251296.1 | A-2337482.1 | 4878 | UGUAGGAGAAUUCACUUUUCA | 829-849 | A-2337478.1 | 5144 | UGAAAAGUGAATUCUCCUACACG | 827-849 |
| AD-1251350.1 | A-2337559.1 | 4879 | GUAGGAGAAUUCACUUUUCUA | 830-850 | A-2337560.1 | 5145 | UAGAAAAGUGAAUUCUCCUACGC | 828-850 |
| AD-1251351.1 | A-2337561.1 | 4880 | GUAGGAGAAUUCACUUUUCUA | 830-850 | A-2337562.1 | 5146 | UAGAAAAGUGAAUUCUCCUACGC | 828-850 |
| AD-1251353.1 | A-2337565.1 | 4881 | UAGGAGAAUUCACUUUUCUUA | 831-851 | A-2337566.1 | 5147 | UAAGAAAAGUGAAUUCUCCUACG | 829-851 |
| AD-1251352.1 | A-2337563.1 | 4882 | UAGGAGAAUUCACUUUUCUUA | 831-851 | A-2337564.1 | 5148 | UAAGAAAAGUGAAUUCUCCUACG | 829-851 |
| AD-1251298.1 | A-2337485.1 | 4883 | UAGGAGAAUUCACUUUUCA | 831-849 | A-2337484.1 | 5149 | UGAAAAGUGAATUCUCCUACG | 829-849 |
| AD-1251297.1 | A-2337483.1 | 4884 | UAGGAGAAUUCACUUUUCA | 831-849 | A-2337484.1 | 5150 | UGAAAAGUGAATUCUCCUACG | 829-849 |
| AD-1251354.1 | A-2337567.1 | 4885 | AGGAGAAUUCACUUUUCUUCA | 832-852 | A-2337568.1 | 5151 | UGAAGAAAAGUGAAUUCUCCUGC | 830-852 |
| AD-1251355.1 | A-2337569.1 | 4886 | GGAGAAUUCACUUUUCUUCGA | 833-853 | A-2337570.1 | 5152 | UCGAAGAAAAGUGAAUUCUCCUG | 831-853 |
| AD-1251356.1 | A-2337571.1 | 4887 | GGAGAAUUCACUUUUCUUCGA | 833-853 | A-2337572.1 | 5153 | UCGAAGAAAAGTGAAUUCUCCUG | 831-853 |
| AD-1251357.1 | A-2337573.1 | 4888 | GAGAAUUCACUUUUCUUCGUA | 834-854 | A-2337574.1 | 5154 | UACGAAGAAAAGUGAAUUCUCCU | 832-854 |
| AD-1251358.1 | A-2337575.1 | 4889 | CCUGAAGCAUAAAUGUUUUCA | 1108-1128 | A-2337576.1 | 5155 | UGAAAACAUUUAUGCUUCAGGUU | 1106-1128 |
| AD-1251359.1 | A-2337577.1 | 4890 | CUGAAGCAUAAAUGUUUUCGA | 1109-1129 | A-2337578.1 | 5156 | UCGAAAACAUUUAUGCUUCAGGU | 1107-1129 |
| AD- | A- | 4891 | CUGAAGCATAAAUGU | 1109-1129 | A- | 5157 | UCGAAAACAUUUAU | 1107-1129 |

TABLE 13B-continued

Exemplary Human SCN9A Unmodified Single Strands and Duplex Sequences.
Column 1 indicates duplex name; the number following the decimal point in a duplex name merely refers to a batch production number. Column 2 indicates the sense sequence name. Column 3 indicates the sequence ID for the sequence of column 4. Column 4 provides the unmodified sequence of a sense strand suitable for use in a duplex described herein. Column 5 provides the position in the target mRNA (NM_001365536.1) of the sense strand of Column 4. Column 6 indicates the antisense sequence name. Column 7 indicates the sequence ID for the sequence of column 8. Column 8 provides the sequence of an antisense strand suitable for use in a duplex described herein, without specifying chemical modifications. Column 9 indicates the position in the target mRNA (NM_001365536.1) that is complementary to the antisense strand of Column 8.

| Duplex Name | Sense sequence name | Seq ID NO: (sense) | Sense sequence (5'-3') | mRNA target range in NM_001365536.1 | Antisense sequence name | Seq ID NO: (antisense) | antisense sequence (5'-3') | mRNA target range in NM_001365536.1 |
|---|---|---|---|---|---|---|---|---|
| 1251360.1 | 2337579.1 | | UUUCGA | | 2337580.1 | | GCUUCAGGU | |
| AD-1251361.1 | A-1852317.1 | 4892 | UGAAGCAUAAAUGUUUUCGAA | 1153-1173 | A-2337581.1 | 5158 | UUCGAAAACAUUAUGCUUCAGG | 1151-1173 |
| AD-1251363.1 | A-2337584.1 | 4893 | GAAGCAUAAAUGUUUUCGAAA | 1111-1131 | A-2337585.1 | 5159 | UUUCGAAAACAUUAUGCUUCAG | 1109-1131 |
| AD-1251362.1 | A-2337582.1 | 4894 | GAAGCAUAAAUGUUUUCGAAA | 1111-1131 | A-2337583.1 | 5160 | UUUCGAAAACAUUUAUGCUUCAG | 1109-1131 |
| AD-1251364.1 | A-1812604.1 | 4895 | AAGCAUAAAUGUUUUCGAAAA | 1112-1132 | A-2337586.1 | 5161 | UUUUCGAAAACAUUUAUGCUUCG | 1110-1132 |
| AD-1251372.1 | A-2337591.1 | 4896 | AGCAUAAAUGUUUUCGAAAUA | 1113-1133 | A-2337598.1 | 5162 | UAUUTCGAAAACAUUUAUGCUUC | 1111-1133 |
| AD-1251366.1 | A-2337589.1 | 4897 | AGCAUAAAUGUUUUCGAAAUA | 1113-1133 | A-1523300.1 | 5163 | UAUUUCGAAAACAUUUAUGCUUC | 1111-1133 |
| AD-1251367.1 | A-2337589.1 | 4898 | AGCAUAAAUGUUUUCGAAAUA | 1113-1133 | A-2337590.1 | 5164 | UAUUTCGAAAACAUUUAUGCUUC | 1111-1133 |
| AD-795634.4 | A-1523299.1 | 4899 | AGCAUAAAUGUUUUCGAAAUA | 1113-1133 | A-1523300.1 | 5165 | UAUUUCGAAAACAUUUAUGCUUC | 1111-1133 |
| AD-1251369.1 | A-2337593.1 | 4900 | AGCAUAAAUGUUUUUGAAAUA | 1113-1133 | A-2337594.1 | 5166 | UAUUTCAAAAACAUUUAUGCUUC | 1111-1133 |
| AD-1251368.1 | A-2337591.1 | 4901 | AGCAUAAAUGUUUUCGAAAUA | 1113-1133 | A-2337592.1 | 5167 | UAUUTCGAAAACAUUUAUGCUUC | 1111-1133 |
| AD-1251373.1 | A-2337591.1 | 4902 | AGCAUAAAUGUUUUCGAAAUA | 1113-1133 | A-2337599.1 | 5168 | UAUUTCGAAAACAUUUAUGCUCC | 1111-1133 |
| AD-1251365.1 | A-2337587.1 | 4903 | AGCAUAAAUGUUUUCGAAAUA | 1113-1133 | A-2337588.1 | 5169 | UAUUTCGAAAACAUUUAUGCUUC | 1111-1133 |
| AD-1251370.1 | A-2337591.1 | 4904 | AGCAUAAAUGUUUUCGAAAUA | 1113-1133 | A-2337595.1 | 5170 | UAUUTCGAAAACAUUUAUGCUCC | 1111-1133 |

TABLE 13B-continued

Exemplary Human SCN9A Unmodified Single Strands and Duplex Sequences.
Column 1 indicates duplex name; the number following the decimal point in a duplex name merely refers to a batch production number. Column 2 indicates the sense sequence name. Column 3 indicates the sequence ID for the sequence of column 4. Column 4 provides the unmodified sequence of a sense strand suitable for use in a duplex described herein. Column 5 provides the position in the target mRNA (NM_001365536.1) of the sense strand of Column 4. Column 6 indicates the antisense sequence name. Column 7 indicates the sequence ID for the sequence of column 8. Column 8 provides the sequence of an antisense strand suitable for use in a duplex described herein, without specifying chemical modifications. Column 9 indicates the position in the target mRNA (NM_001365536.1) that is complementary to the antisense strand of Column 8.

| Duplex Name | Sense sequence name | Seq ID NO: (sense) | Sense sequence (5'-3') | mRNA target range in NM_001365536.1 | Antisense sequence name | Seq ID NO: (antisense) | antisense sequence (5'-3') | mRNA target range in NM_001365536.1 |
|---|---|---|---|---|---|---|---|---|
| AD-1251374.1 | A-2337600.1 | 4905 | GCAUAAAUGUUUUCGAAAUUA | 1114-1134 | A-2337601.1 | 5171 | UAAUTUCGAAAACAUUUAUGCUU | 1112-1134 |
| AD-1251375.1 | A-2337602.1 | 4906 | CAUAAAUGUUUUCGAAAUUCA | 1115-1135 | A-2337603.1 | 5172 | UGAATUTCGAAAACAUUUAUGCU | 1113-1135 |
| AD-1251371.1 | A-2337596.1 | 4907 | CAUAAAUGUUUUCGAAAUA | 1115-1133 | A-2337597.1 | 5173 | UAUUTCGAAAACAUUUAUGCU | 1113-1133 |
| AD-1251376.1 | A-2337604.1 | 4908 | AUAAAUGUUUUCGAAAUUCAA | 1116-1136 | A-2337605.1 | 5174 | UUGAAUTUCGAAAACAUUUAUGC | 1114-1136 |
| AD-1251377.1 | A-2337604.1 | 4909 | AUAAAUGUUUUCGAAAUUCAA | 1116-1136 | A-2337606.1 | 5175 | UUGAAUTUCGAAAACAUUUAUGU | 1114-1136 |
| AD-1251378.1 | A-2337607.1 | 4910 | UAAAUGUUUUCGAAAUUCACA | 1117-1137 | A-2337608.1 | 5176 | UGUGAATUUCGAAAACAUUUAUG | 1115-1137 |
| AD-1251379.1 | A-2337609.1 | 4911 | AAAUGUUUUCGAAAUUCACUA | 1118-1138 | A-2337610.1 | 5177 | UAGUGAAUUUCGAAAACAUUUGU | 1116-1138 |
| AD-1251380.1 | A-2337611.1 | 4912 | UACAUGAUCUUCUUUGUCGUA | 1430-1450 | A-2337612.1 | 5178 | UACGACAAAGAAGAUCAUGUAGG | 1428-1450 |
| AD-1251381.1 | A-2337613.1 | 4913 | UACAUGAUCUUCUUUGUCGUA | 1430-1450 | A-2337614.1 | 5179 | UACGACAAAGAAGAUCAUGUACC | 1428-1450 |
| AD-1251382.1 | A-2337615.1 | 4914 | ACAUGAUCUUCUUUGUCGUAA | 1431-1451 | A-2337616.1 | 5180 | UUACGACAAAGAAGAUCAUGUGG | 1429-1451 |
| AD-1251384.1 | A-1523843.1 | 4915 | CAUGAUCUUCUUUGUCGUAGA | 1432-1452 | A-2337457.1 | 5181 | UCUACGACAAAGAAGAUCAUGUG | 1430-1452 |
| AD-1251274.2 | A-2337449.1 | 4916 | CAUGAUCUUCUUUGUCGUAGA | 1432-1452 | A-2337457.1 | 5182 | UCUACGACAAAGAAGAUCAUGUG | 1430-1452 |
| AD-961188.3 | A-1812612.1 | 4917 | CAUGAUCUTCTUUGUCGUAGA | 1432-1452 | A-1812613.1 | 5183 | UCUACGACAAAGAAGAUCAUGUA | 1430-1452 |

TABLE 13B-continued

Exemplary Human SCN9A Unmodified Single Strands and Duplex Sequences.
Column 1 indicates duplex name; the number following the decimal point in a duplex name merely refers to a batch production number. Column 2 indicates the sense sequence name. Column 3 indicates the sequence ID for the sequence of column 4. Column 4 provides the unmodified sequence of a sense strand suitable for use in a duplex described herein. Column 5 provides the position in the target mRNA (NM_001365536.1) of the sense strand of Column 4. Column 6 indicates the antisense sequence name. Column 7 indicates the sequence ID for the sequence of column 8. Column 8 provides the sequence of an antisense strand suitable for use in a duplex described herein, without specifying chemical modifications. Column 9 indicates the position in the target mRNA (NM_001365536.1) that is complementary to the antisense strand of Column 8.

| Duplex Name | Sense sequence name | Seq ID NO: (sense) | Sense sequence (5'-3') | mRNA target range in NM_001365536.1 | Antisense sequence name | Seq ID NO: (antisense) | antisense sequence (5'-3') | mRNA target range in NM_001365536.1 |
|---|---|---|---|---|---|---|---|---|
| AD-1251383.1 | A-1523843.1 | 4918 | CAUGAUCUUCUUUGUCGUAGA | 1432-1452 | A-2337617.1 | 5184 | UCUACGACAAAGAAGAUCAUGUG | 1430-1452 |
| AD-1251269.1 | A-2337449.1 | 4919 | CAUGAUCUUCUUUGUCGUAGA | 1432-1452 | A-2337451.1 | 5185 | UCUACGACAAAGAAGAUCAUGUG | 1430-1452 |
| AD-1251270.1 | A-2337449.1 | 4920 | CAUGAUCUUCUUUGUCGUAGA | 1432-1452 | A-2337452.1 | 5186 | UCUACGACAAAGAAGAUCAUGCC | 1430-1452 |
| AD-1251268.1 | A-2337449.1 | 4921 | CAUGAUCUUCUUUGUCGUAGA | 1432-1452 | A-2337450.1 | 5187 | UCUACGACAAAGAAGAUCAUGUG | 1430-1452 |
| AD-1251274.1 | A-2337449.1 | 4922 | CAUGAUCUUCUUUGUCGUAGA | 1432-1452 | A-2337457.1 | 5188 | UCUACGACAAAGAAGAUCAUGUG | 1430-1452 |
| AD-1251271.1 | A-2337449.1 | 4923 | CAUGAUCUUCUUUGUCGUAGA | 1432-1452 | A-2337453.1 | 5189 | UCUACGACAAAGAAGAUCAUGCC | 1430-1452 |
| AD-1251275.2 | A-2337449.1 | 4924 | CAUGAUCUUCUUUGUCGUAGA | 1432-1452 | A-2337458.1 | 5190 | UCUACGACAAAGAAGAUCAUGUG | 1430-1452 |
| AD-1251275.1 | A-2337449.1 | 4925 | CAUGAUCUUCUUUGUCGUAGA | 1432-1452 | A-2337458.1 | 5191 | UCUACGACAAAGAAGAUCAUGUG | 1430-1452 |
| AD-1251385.1 | A-1523845.1 | 4926 | AUGAUCUUCUUUGUCGUAGUA | 1433-1453 | A-2337618.1 | 5192 | UACUACGACAAAGAAGAUCAUGU | 1431-1453 |
| AD-1251272.1 | A-2337454.1 | 4927 | UGAUCUUCUUUGUCGUAGA | 1434-1452 | A-2337455.1 | 5193 | UCUACGACAAAGAAGAUCAUG | 1432-1452 |
| AD-1251386.1 | A-1523847.1 | 4928 | UGAUCUUCUUUGUCGUAGUGA | 1434-1454 | A-2337619.1 | 5194 | UCACTACGACAAAGAAGAUCAUG | 1432-1454 |
| AD-1251273.1 | A-2337454.1 | 4929 | UGAUCUUCUUUGUCGUAGA | 1434-1452 | A-2337456.1 | 5195 | UCUACGACAAAGAAGAUCAUG | 1432-1452 |
| AD-1251390.1 | A-2337622.1 | 4930 | GAUCUUCUUUGUCGUAGUGAA | 1435-1455 | A-2337624.1 | 5196 | UUCACUACGACAAAGAAGAUCGU | 1433-1455 |
| AD- | A- | 4931 | GAUCUUCUUUGUCG | 1435-1455 | A- | 5197 | UUCACUACGACAAA | 1433-1455 |

TABLE 13B-continued

Exemplary Human SCN9A Unmodified Single Strands and Duplex Sequences.
Column 1 indicates duplex name; the number following the decimal point in a duplex name merely refers to a batch production number. Column 2 indicates the sense sequence name. Column 3 indicates the sequence ID for the sequence of column 4. Column 4 provides the unmodified sequence of a sense strand suitable for use in a duplex described herein. Column 5 provides the position in the target mRNA (NM_001365536.1) of the sense strand of Column 4. Column 6 indicates the antisense sequence name. Column 7 indicates the sequence ID for the sequence of column 8. Column 8 provides the sequence of an antisense strand suitable for use in a duplex described herein, without specifying chemical modifications. Column 9 indicates the position in the target mRNA (NM_001365536.1) that is complementary to the antisense strand of Column 8.

| Duplex Name | Sense sequence name | Seq ID NO: (sense) | Sense sequence (5'-3') | mRNA target range in NM_001365536.1 | Antisense sequence name | Seq ID NO: (antisense) | antisense sequence (5'-3') | mRNA target range in NM_001365536.1 |
|---|---|---|---|---|---|---|---|---|
| 1251398.1 | 2337622.1 | | UAGUGAA | | 2337630.1 | | GAAGAUCGU | |
| AD-1251396.1 | A-2337629.1 | 4932 | GAUCUUCUUUGUCG UAGUGAA | 1435-1455 | A-2337621.1 | 5198 | UUCACUACGACAAA GAAGAUCGU | 1433-1455 |
| AD-1251399.1 | A-2337628.1 | 4933 | GAUCUUCUUUGUCG UAGUGAA | 1435-1455 | A-2337630.1 | 5199 | UUCACUACGACAAA GAAGAUCGU | 1433-1455 |
| AD-795913.3 | A-1523849.1 | 4934 | GAUCUUCUUUGUCG UAGUGAA | 1435-1455 | A-1523850.1 | 5200 | UUCACUACGACAAA GAAGAUCAU | 1433-1455 |
| AD-1251400.1 | A-2337629.1 | 4935 | GAUCUUCUUUGUCG UAGUGAA | 1435-1455 | A-2337631.1 | 5201 | UUCACUACGACAAA GAAGAUCGU | 1433-1455 |
| AD-1251388.1 | A-1523849.1 | 4936 | GAUCUUCUUUGUCG UAGUGAA | 1435-1455 | A-2337621.1 | 5202 | UUCACUACGACAAA GAAGAUCGU | 1433-1455 |
| AD-1251397.1 | A-1812618.1 | 4937 | GAUCUUCUTUGUCG UAGUGAA | 1435-1455 | A-2337624.1 | 5203 | UUCACUACGACAAA GAAGAUCGU | 1433-1455 |
| AD-1251395.1 | A-2337628.1 | 4938 | GAUCUUCUUUGUCG UAGUGAA | 1435-1455 | A-2337624.1 | 5204 | UUCACUACGACAAA GAAGAUCGU | 1433-1455 |
| AD-1251387.1 | A-1523849.1 | 4939 | GAUCUUCUUUGUCG UAGUGAA | 1435-1455 | A-2337620.1 | 5205 | UUCACUACGACAAA GAAGAUCGU | 1433-1455 |
| AD-1251389.1 | A-2337622.1 | 4940 | GAUCUUCUUUGUCG UAGUGAA | 1435-1455 | A-2337623.1 | 5206 | UUCACUACGACAAA GAAGAUCGU | 1433-1455 |
| AD-1251393.1 | A-2337628.1 | 4941 | GAUCUUCUUUGUCG UAGUGAA | 1435-1455 | A-2337623.1 | 5207 | UUCACUACGACAAA GAAGAUCGU | 1433-1455 |
| AD-1251394.1 | A-2337629.1 | 4942 | GAUCUUCUUUGUCG UAGUGAA | 1435-1455 | A-2337620.1 | 5208 | UUCACUACGACAAA GAAGAUCGU | 1433-1455 |
| AD-1251401.1 | A-2337632.1 | 4943 | AUCUUCUUUGUCGU AGUGAUA | 1436-1456 | A-2337633.1 | 5209 | UAUCACTACGACAA AGAAGAUCG | 1434-1456 |
| AD-1251391.1 | A-2337625.1 | 4944 | UCUUCUUUGUCGUA GUGAA | 1437-1455 | A-2337626.1 | 5210 | UUCACUACGACAAA GAAGAUC | 1435-1455 |

TABLE 13B-continued

Exemplary Human SCN9A Unmodified Single Strands and Duplex Sequences.
Column 1 indicates duplex name; the number following the decimal point in a duplex name merely refers to a batch production number. Column 2 indicates the sense sequence name. Column 3 indicates the sequence ID for the sequence of column 4. Column 4 provides the unmodified sequence of a sense strand suitable for use in a duplex described herein. Column 5 provides the position in the target mRNA (NM_001365536.1) of the sense strand of Column 4. Column 6 indicates the antisense sequence name. Column 7 indicates the sequence ID for the sequence of column 8. Column 8 provides the sequence of an antisense strand suitable for use in a duplex described herein, without specifying chemical modifications. Column 9 indicates the position in the target mRNA (NM_001365536.1) that is complementary to the antisense strand of Column 8.

| Duplex Name | Sense sequence name | Seq ID NO: (sense) | Sense sequence (5'-3') | mRNA target range in NM_001365536.1 | Antisense sequence name | Seq ID NO: (antisense) | antisense sequence (5'-3') | mRNA target range in NM_001365536.1 |
|---|---|---|---|---|---|---|---|---|
| AD-1251392.1 | A-2337625.1 | 4945 | UCUUCUUUGUCGUAGUGAA | 1437-1455 | A-2337627.1 | 5211 | UUCACUACGACAAAGAAGAUC | 1435-1455 |
| AD-1251402.1 | A-2337634.1 | 4946 | UCUUCUUUGUCGUAGUGAUUA | 1437-1457 | A-2337635.1 | 5212 | UAAUCACUACGACAAAGAAGAUC | 1435-1457 |
| AD-1251403.1 | A-2337636.1 | 4947 | CUUCUUUGUCGUAGUGAUUUA | 1438-1458 | A-2337637.1 | 5213 | UAAATCACUACGACAAAGAAGGU | 1436-1458 |
| AD-1251404.1 | A-2337638.1 | 4948 | UUCUUUGUCGUAGUGAUUUUA | 1439-1459 | A-2337639.1 | 5214 | UAAAAUCACUACGACAAAGAAGG | 1437-1459 |
| AD-1251405.1 | A-2337640.1 | 4949 | UCUUUGUCGUAGUGAUUUUCA | 1440-1460 | A-2337641.1 | 5215 | UGAAAATCACUACGACAAAGAGG | 1438-1460 |
| AD-1251406.1 | A-2337642.1 | 4950 | AUCCUUUUGUAGAUCUUGCAA | 2526-2546 | A-2337643.1 | 5216 | UUGCAAGAUCUACAAAAGGAUCC | 2524-2546 |
| AD-1251407.1 | A-2337644.1 | 4951 | UCCUUUUGUAGAUCUUGCAAA | 2527-2547 | A-2337645.1 | 5217 | UUUGCAAGAUCTACAAAAGGAUC | 2525-2547 |
| AD-1251408.1 | A-1854629.1 | 4952 | CCUUUUGUAGAUCUUGCAAUA | 2538-2558 | A-2337646.1 | 5218 | UAUUGCAAGAUCUACAAAAGGGU | 2536-2558 |
| AD-1251409.1 | A-2337647.1 | 4953 | CUUUUGUAGAUCUUGCAAUUA | 2529-2549 | A-2337648.1 | 5219 | UAAUTGCAAGAUCUACAAAAGGG | 2527-2549 |
| AD-1251411.1 | A-2337650.1 | 4954 | UUUUGUAGAUCUUGCAAUUAA | 2530-2550 | A-2337651.1 | 5220 | UUAATUGCAAGAUCUACAAAGCC | |
| AD-1251410.1 | A-1525635.1 | 4955 | UUUUGUAGAUCUUGCAAUUAA | 2530-2550 | A-2337649.1 | 5221 | UUAATUGCAAGAUCUACAAAAGG | 2528-2550 |
| AD-1251412.1 | A-2337652.1 | 4956 | UUUGUAGAUCUUGCAAUUACA | 2531-2551 | A-2337653.1 | 5222 | UGUAAUUGCAAGAUCUACAAAGG | 2529-2551 |
| AD-796825.3 | A-1525636.1 | 4957 | UUUGUAGAUCUUGCAAUUACA | 2531-2551 | A-1257916.1 | 5223 | UGUAAUUGCAAGAUCUACAAAAG | 2529-2551 |

TABLE 13B-continued

Exemplary Human SCN9A Unmodified Single Strands and Duplex Sequences.
Column 1 indicates duplex name; the number following the decimal point in a duplex name merely refers to a batch production number. Column 2 indicates the sense sequence name. Column 3 indicates the sequence ID for the sequence of column 4. Column 4 provides the unmodified sequence of a sense strand suitable for use in a duplex described herein. Column 5 provides the position in the target mRNA (NM_001365536.1) of the sense strand of Column 4. Column 6 indicates the antisense sequence name. Column 7 indicates the sequence ID for the sequence of column 8. Column 8 provides the sequence of an antisense strand suitable for use in a duplex described herein, without specifying chemical modifications. Column 9 indicates the position in the target mRNA (NM_001365536.1) that is complementary to the antisense strand of Column 8.

| Duplex Name | Sense sequence name | Seq ID NO: (sense) | Sense sequence (5'-3') | mRNA target range in NM_001365536.1 | Antisense sequence name | Seq ID NO: (antisense) | antisense sequence (5'-3') | mRNA target range in NM_001365536.1 |
|---|---|---|---|---|---|---|---|---|
| AD-1251413.1 | A-2337652.1 | 4958 | UUUGUAGAUCUUGCAAUUACA | 2531-2551 | A-2337654.1 | 5224 | UGUAAUTGCAAGAUCUACAAAGG | 2529-2551 |
| AD-1251414.1 | A-2337652.1 | 4959 | UUUGUAGAUCUUGCAAUUACA | 2531-2551 | A-2337655.1 | 5225 | UGUAAUUGCAAGAUCUACAAAGG | 2529-2551 |
| AD-1251415.1 | A-2337652.1 | 4960 | UUUGUAGAUCUUGCAAUUACA | 2531-2551 | A-2337656.1 | 5226 | UGUAAUTGCAAGAUCUACAAAGG | 2529-2551 |
| AD-1251416.1 | A-2337652.1 | 4961 | UUUGUAGAUCUUGCAAUUACA | 2531-2551 | A-2337657.1 | 5227 | UGUAAUUGCAAGAUCUACAAAGG | 2529-2551 |
| AD-1251417.1 | A-2337658.1 | 4962 | UUGUAGAUCUUGCAAUUACCA | 2532-2552 | A-2337659.1 | 5228 | UGGUAAUUGCAAGAUCUACAAGG | 2530-2552 |
| AD-1251418.1 | A-2337660.1 | 4963 | UGUAGAUCUUGCAAUUACCAA | 2533-2553 | A-2337661.1 | 5229 | UUGGTAAUUGCAAGAUCUACAGG | 2531-2553 |
| AD-1251419.1 | A-2337662.1 | 4964 | GUAGAUCUUGCAAUUACCAUA | 2534-2554 | A-2337663.1 | 5230 | UAUGGUAAUUGCAAGAUCUACGG | 2532-2554 |
| AD-1251420.1 | A-2337664.1 | 4965 | UAGAUCUUGCAAUUACCAUUA | 2535-2555 | A-2337665.1 | 5231 | UAAUGGTAAUUGCAAGAUCUACG | 2533-2555 |
| AD-1251421.1 | A-1525641.1 | 4966 | AGAUCUUGCAAUUACCAUUUA | 2536-2556 | A-2337666.1 | 5232 | UAAATGGUAAUUGCAAGAUCUGC | 2534-2556 |
| AD-1251422.1 | A-2337667.1 | 4967 | AGAUCUUGCAAUUACCAUUUA | 2536-2556 | A-2337668.1 | 5233 | UAAATGGUAAUTGCAAGAUCUGC | 2534-2556 |
| AD-1251423.1 | A-1856083.1 | 4968 | UAAAUUAUGUGAAACAAACCA | 3304-3324 | A-2337669.1 | 5234 | UGGUTUGUUUCACAUAAUUUAUU | 3302-3324 |
| AD-1251425.1 | A-1856087.1 | 4969 | AAUUAUGUGAAACAAACCUUA | 3306-3326 | A-2337672.1 | 5235 | UAAGGUUUGUUTCACAUAAUUUG | 3304-3326 |
| AD-1251427.1 | A-2337675.1 | 4970 | AUUAUGUGAAACAAACCUUAA | 3297-3317 | A-2337676.1 | 5236 | UUAAGGTUUGUTUCACAUAAUUU | 3295-3317 |
| AD- | A- | 4971 | AUUAUGUGAAACAA | 3297-3317 | A- | 5237 | UUAAGGTUUGUUU | 3295-3317 |

TABLE 13B-continued

Exemplary Human SCN9A Unmodified Single Strands and Duplex Sequences. Column 1 indicates duplex name; the number following the decimal point in a duplex name merely refers to a batch production number. Column 2 indicates the sense sequence name. Column 3 indicates the sequence ID for the sequence of column 4. Column 4 provides the unmodified sequence of a sense strand suitable for use in a duplex described herein. Column 5 provides the position in the target mRNA (NM_001365536.1) of the sense strand of Column 4. Column 6 indicates the antisense sequence name. Column 7 indicates the sequence ID for the sequence of column 8. Column 8 provides the sequence of an antisense strand suitable for use in a duplex described herein, without specifying chemical modifications. Column 9 indicates the position in the target mRNA (NM_001365536.1) that is complementary to the antisense strand of Column 8.

| Duplex Name | Sense sequence name | Seq ID NO: (sense) | Sense sequence (5'-3') | mRNA target range in NM_001365536.1 | Antisense sequence name | Seq ID NO: (antisense) | antisense sequence (5'-3') | mRNA target range in NM_001365536.1 |
|---|---|---|---|---|---|---|---|---|
| 1251426.1 | 2337673.1 | | ACCUUAA | | 2337674.1 | | CACAUAAUUU | |
| AD-1251428.1 | A-2337677.1 | 4972 | UUAUGUGAAACAAACCUUACA | 3298-3318 | A-2337678.1 | 5238 | UGUAAGGUUUGUUUCACAUAAUU | 3296-3318 |
| AD-797564.4 | A-1527042.1 | 4973 | UAUGUGAAACAAACCUUACGA | 3299-3319 | A-1527043.1 | 5239 | UCGUAAGGUUUGUUUCACAUAAU | 3297-3319 |
| AD-1251434.1 | A-2337679.1 | 4974 | UAUGUGAAACAAACCUUACGA | 3299-3319 | A-2337687.1 | 5240 | UCGUAAGGUUUGUUUCACAUAGU | 3297-3319 |
| AD-1251431.1 | A-2337681.1 | 4975 | UAUGUGAAACAAACUUUACGA | 3299-3319 | A-2337682.1 | 5241 | UCGUAAAGUUUGUUUCACAUAGU | 3297-3319 |
| AD-1251433.1 | A-2337685.1 | 4976 | UAUGUGAAACAAACCUUACGA | 3299-3319 | A-2337686.1 | 5242 | UCGUAAGGUUUGUUUCACAUAGU | 3297-3319 |
| AD-1251430.1 | A-2337679.1 | 4977 | UAUGUGAAACAAACCUUACGA | 3299-3319 | A-2337680.1 | 5243 | UCGUAAGGUUUGUUUCACAUAGU | 3297-3319 |
| AD-1251429.1 | A-2337679.1 | 4978 | UAUGUGAAACAAACCUUACGA | 3299-3319 | A-1527043.1 | 5244 | UCGUAAGGUUUGUUUCACAUAAU | 3297-3319 |
| AD-1251435.1 | A-2337685.1 | 4979 | UAUGUGAAACAAACCUUACGA | 3299-3319 | A-2337688.1 | 5245 | UCGUAAGGUUUGUUUCACAUAGU | 3297-3319 |
| AD-1251438.1 | A-2337689.1 | 4980 | AUGUGAAACAAACCUUACGUA | 3300-3320 | A-2337691.1 | 5246 | UACGTAAGGUUUGUUUCACAUGG | 3298-3320 |
| AD-1251436.1 | A-2337689.1 | 4981 | AUGUGAAACAAACCUUACGUA | 3300-3320 | A-1527045.1 | 5247 | UACGUAAGGUUUGUUUCACAUAA | 3298-3320 |
| AD-1251437.1 | A-2337689.1 | 4982 | AUGUGAAACAAACCUUACGUA | 3300-3320 | A-2337690.1 | 5248 | UACGTAAGGUUUGUUUCACAUGG | 3298-3320 |
| AD-797565.4 | A-1527044.1 | 4983 | AUGUGAAACAAACCUUACGUA | 3300-3320 | A-1527045.1 | 5249 | UACGUAAGGUUUGUUUCACAUAA | 3298-3320 |
| AD-1251443.1 | A-2337689.1 | 4984 | AUGUGAAACAAACCUUACGUA | 3300-3320 | A-2337698.1 | 5250 | UACGTAAGGUUUGUUUCACAUGG | 3298-3320 |

TABLE 13B-continued

Exemplary Human SCN9A Unmodified Single Strands and Duplex Sequences.
Column 1 indicates duplex name; the number following the decimal point in a duplex name merely refers to a batch production number. Column 2 indicates the sense sequence name. Column 3 indicates the sequence ID for the sequence of column 4. Column 4 provides the unmodified sequence of a sense strand suitable for use in a duplex described herein. Column 5 provides the position in the target mRNA (NM_001365536.1) of the sense strand of Column 4. Column 6 indicates the antisense sequence name. Column 7 indicates the sequence ID for the sequence of column 8. Column 8 provides the sequence of an antisense strand suitable for use in a duplex described herein, without specifying chemical modifications. Column 9 indicates the position in the target mRNA (NM_001365536.1) that is complementary to the antisense strand of Column 8.

| Duplex Name | Sense sequence name | Seq ID NO: (sense) | Sense sequence (5'-3') | mRNA target range in NM_001365536.1 | Antisense sequence name | Seq ID NO: (antisense) | antisense sequence (5'-3') | mRNA target range in NM_001365536.1 |
|---|---|---|---|---|---|---|---|---|
| AD-1251444.1 | A-2337695.1 | 4985 | AUGUGAAACAAACCUUACGUA | 3300-3320 | A-2337699.1 | 5251 | UACGTAAGGUUTGUUUCACAUGG | 3298-3320 |
| AD-1251442.1 | A-2337695.1 | 4986 | AUGUGAAACAAACCUUACGUA | 3300-3320 | A-2337697.1 | 5252 | UACGTAAGGUUTGUUUCACAUGG | 3298-3320 |
| AD-1251441.1 | A-2337695.1 | 4987 | AUGUGAAACAAACCUUACGUA | 3300-3320 | A-2337696.1 | 5253 | UACGTAAGGUUTGUUUCACAUGG | 3298-3320 |
| AD-1251445.1 | A-2337700.1 | 4988 | UGUGAAACAAACCUUACGUGA | 3301-3321 | A-2337701.1 | 5254 | UCACGUAAGGUTUGUUUCACAUG | 3299-3321 |
| AD-1251439.1 | A-2337692.1 | 4989 | GUGAAACAAACCUUACGUA | 3302-3320 | A-2337693.1 | 5255 | UACGTAAGGUUUGUUUCACGU | 3300-3320 |
| AD-1251447.1 | A-2337704.1 | 4990 | GUGAAACAAACCUUACGUGAA | 3302-3322 | A-2337705.1 | 5256 | UUCACGTAAGGTUUGUUUCACGU | 3300-3322 |
| AD-1251446.1 | A-2337702.1 | 4991 | GUGAAACAAACCUUACGUGAA | 3302-3322 | A-2337703.1 | 5257 | UUCACGTAAGGUUUGUUUCACGU | 3300-3322 |
| AD-1251448.1 | A-2337706.1 | 4992 | UGAAACAAACCUUACGUGAAA | 3303-3323 | A-2337707.1 | 5258 | UUUCACGUAAGGUUUGUUUCACA | 3301-3323 |
| AD-1251450.1 | A-2337710.1 | 4993 | GAAACAAACCUUACGUGAAUA | 3304-3324 | A-2337711.1 | 5259 | UAUUCACGUAAGGUUUGUUUCAC | 3302-3324 |
| AD-1251449.1 | A-2337708.1 | 4994 | GAAACAAACCUUACGUGAAUA | 3304-3324 | A-2337709.1 | 5260 | UAUUCACGUAAGGUUUGUUUCAC | 3302-3324 |
| AD-1251451.1 | A-2337712.1 | 4995 | AAACAAACCUUACGUGAAUUA | 3305-3325 | A-2337713.1 | 5261 | UAAUTCACUGAAGGUUUGUUUCG | |
| AD-1251453.1 | A-2337716.1 | 4996 | UGUGAUAUAUUUUACAACAUA | 8017-8037 | A-2337717.1 | 5262 | UAUGTUGUAAAAUAUAUCACAGU | 8015-8037 |
| AD-1251452.1 | A-2337714.1 | 4997 | UGUGAUAUAUUUUACAACAUA | 8017-8037 | A-2337715.1 | 5263 | UAUGTUGUAAAAUAUAUCACAGU | 8015-8037 |

TABLE 13B-continued

Exemplary Human SCN9A Unmodified Single Strands and Duplex Sequences.
Column 1 indicates duplex name; the number following the decimal point in a duplex name merely refers to a batch production number. Column 2 indicates the sense sequence name. Column 3 indicates the sequence ID for the sequence of column 4. Column 4 provides the unmodified sequence of a sense strand suitable for use in a duplex described herein. Column 5 provides the position in the target mRNA (NM_001365536.1) of the sense strand of Column 4. Column 6 indicates the antisense sequence name. Column 7 indicates the sequence ID for the sequence of column 8. Column 8 provides the sequence of an antisense strand suitable for use in a duplex described herein, without specifying chemical modifications. Column 9 indicates the position in the target mRNA (NM_001365536.1) that is complementary to the antisense strand of Column 8.

| Duplex Name | Sense sequence name | Seq ID NO: (sense) | Sense sequence (5'-3') | mRNA target range in NM_001365536.1 | Antisense sequence name | Seq ID NO: (antisense) | antisense sequence (5'-3') | mRNA target range in NM_001365536.1 |
|---|---|---|---|---|---|---|---|---|
| AD-1251454.1 | A-2337718.1 | 4998 | GUGAUAUAUUUUACAACAUCA | 8018-8038 | A-2337719.1 | 5264 | UGAUGUUGUAAAAUAUAUCACGG | 8016-8038 |
| AD-1251455.1 | A-2337720.1 | 4999 | UGAUAUAUUUUACAACAUCCA | 8019-8039 | A-2337721.1 | 5265 | UGGATGUUGUAAAAUAUAUCACG | 8017-8039 |
| AD-1251456.1 | A-2337722.1 | 5000 | GAUAUAUUUUACAACAUCCGA | 8020-8040 | A-2337723.1 | 5266 | UCGGAUGUUGUAAAAUAUAUCGC | 8018-8040 |
| AD-1251457.1 | A-2337724.1 | 5001 | GAUAUAUUUUACAACAUCCGA | 8020-8040 | A-2337725.1 | 5267 | UCGGAUGUUGUAAAAUAUAUCGC | 8018-8040 |
| AD-1251459.1 | A-2337727.1 | 5002 | AUAUAUUUUACAACAUCCGUA | 8021-8041 | A-2337728.1 | 5268 | UACGGATGUUGTAAAAUAUAUCG | 8019-8041 |
| AD-1251458.1 | A-1535069.1 | 5003 | AUAUAUUUUACAACAUCCGUA | 8021-8041 | A-2337726.1 | 5269 | UACGGATGUUGUAAAAUAUAUCG | 8019-8041 |
| AD-1251462.1 | A-1535071.1 | 5004 | UAUAUUUUACAACAUCCGUUA | 8022-8042 | A-2337731.1 | 5270 | UAACGGAUGUUGUAAAAUAUACC | 8020-8042 |
| AD-1251461.1 | A-1535071.1 | 5005 | UAUAUUUUACAACAUCCGUUA | 8022-8042 | A-2337730.1 | 5271 | UAACGGAUGUUGUAAAAUAUAUC | 8020-8042 |
| AD-1251468.1 | A-1535071.1 | 5006 | UAUAUUUUACAACAUCCGUUA | 8022-8042 | A-2337738.1 | 5272 | UAACGGAUGUUGUAAAAUAUACC | 8020-8042 |
| AD-1251463.1 | A-1535071.1 | 5007 | UAUAUUUUACAACAUCCGUUA | 8022-8042 | A-2337732.1 | 5273 | UAACGGAUGUUGUAAAAUAUACC | 8020-8042 |
| AD-1251460.1 | A-1535071.1 | 5008 | UAUAUUUUACAACAUCCGUUA | 8022-8042 | A-2337729.1 | 5274 | UAACGGAUGUUGUAAAAUAUAUC | 8020-8042 |
| AD-1251469.1 | A-1864159.1 | 5009 | UAUAUUUUACAACAUCCGUUA | 8032-8052 | A-2337739.1 | 5275 | UAACGGAUGUUGUAAAAUAUAUC | 8030-8052 |
| AD-801647.3 | A-1535071.1 | 5010 | UAUAUUUUACAACAUCCGUUA | 8022-8042 | A-1535072.1 | 5276 | UAACGGAUGUUGUAAAAUAUAUC | 8020-8042 |
| AD- | A- | 5011 | UAUAUUUUACAACA | 8032-8052 | A- | 5277 | UAACGGAUGUUGU | 8030-8052 |

TABLE 13B-continued

Exemplary Human SCN9A Unmodified Single Strands and Duplex Sequences.
Column 1 indicates duplex name; the number following the decimal point in a duplex name merely refers to a batch production number. Column 2 indicates the sense sequence name. Column 3 indicates the sequence ID for the sequence of column 4. Column 4 provides the unmodified sequence of a sense strand suitable for use in a duplex described herein. Column 5 provides the position in the target mRNA (NM_001365536.1) of the sense strand of Column 4. Column 6 indicates the antisense sequence name. Column 7 indicates the sequence ID for the sequence of column 8. Column 8 provides the sequence of an antisense strand suitable for use in a duplex described herein, without specifying chemical modifications. Column 9 indicates the position in the target mRNA (NM_001365536.1) that is complementary to the antisense strand of Column 8.

| Duplex Name | Sense sequence name | Seq ID NO: (sense) | Sense sequence (5'-3') | mRNA target range in NM_001365536.1 | Antisense sequence name | Seq ID NO: (antisense) | antisense sequence (5'-3') | mRNA target range in NM_001365536.1 |
|---|---|---|---|---|---|---|---|---|
| 1251467.1 | 1864159.1 | | UCCGUUA | | 2337737.1 | | AAAAUAUAUC | |
| AD-1251466.1 | A-2337736.1 | 5012 | UAUAUUUUACAACAUCCGUUA | 8022-8042 | A-2337737.1 | 5278 | UAACGGAUGUUGUAAAAUAUAUC | 8020-8042 |
| AD-1251470.1 | A-1535073.1 | 5013 | AUAUUUUACAACAUCCGUUAA | 8023-8043 | A-2337740.1 | 5279 | UUAACGGAUGUUGUAAAAUAUGU | 8021-8043 |
| AD-1251471.1 | A-2337741.1 | 5014 | AUAUUUUACAACAUCCGUUAA | 8023-8043 | A-2337742.1 | 5280 | UUAACGGAUGUTGUAAAAUAUGU | 8021-8043 |
| AD-1251465.1 | A-2337733.1 | 5015 | UAUUUUACAACAUCCGUUA | 8024-8042 | A-2337735.1 | 5281 | UAACGGAUGUUGUAAAAUAUG | 8022-8042 |
| AD-1251472.1 | A-2337743.1 | 5016 | UAUUUUACAACAUCCGUUAUA | 8024-8044 | A-2337744.1 | 5282 | UAUAACGGAUGTUGUAAAAUAUG | 8022-8044 |
| AD-1251464.1 | A-2337733.1 | 5017 | UAUUUUACAACAUCCGUUA | 8024-8042 | A-2337734.1 | 5283 | UAACGGAUGUUGUAAAAUAUG | 8022-8042 |
| AD-1251473.1 | A-2337745.1 | 5018 | AUUUUACAACAUCCGUUAUUA | 8025-8045 | A-2337746.1 | 5284 | UAAUAACGGAUGUUGUAAAAUGU | 8023-8045 |
| AD-1251474.1 | A-2337747.1 | 5019 | AUUUUACAACAUCCGUUAUUA | 8025-8045 | A-2337748.1 | 5285 | UAAUAACGGAUGUUGUAAAAUGU | 8023-8045 |
| AD-1251475.1 | A-2337749.1 | 5020 | UUUUACAACAUCCGUUAUUAA | 8026-8046 | A-2337750.1 | 5286 | UUAATAACGGATGUUGUAAAAUG | 8024-8046 |
| AD-1251476.1 | A-2337751.1 | 5021 | UUUACAACAUCCGUUAUUACA | 8027-8047 | A-2337752.1 | 5287 | UGUAAUAACGGAUGUUGUAAAGU | 8025-8047 |
| AD-1251279.1 | A-2337459.1 | 5022 | CAACACAAUUUCUUCUUAGCA | 8498-8518 | A-2337464.1 | 5288 | UGCUAAGAAGAAAUUGUGUUGUU | 8496-8518 |
| AD-1251276.1 | A-2337459.1 | 5023 | CAACACAAUUUCUUCUUAGCA | 8498-8518 | A-2337460.1 | 5289 | UGCUAAGAAGAAAUUGUGUUGUU | 8496-8518 |
| AD-1251280.1 | A-2337459.1 | 5024 | CAACACAAUUUCUUCUUAGCA | 8498-8518 | A-2337465.1 | 5290 | UGCUAAGAAGAAAUUGUGUUGCC | 8496-8518 |

TABLE 13B-continued

Exemplary Human SCN9A Unmodified Single Strands and Duplex Sequences.
Column 1 indicates duplex name; the number following the decimal point in a duplex name merely refers to a batch production number. Column 2 indicates the sense sequence name. Column 3 indicates the sequence ID for the sequence of column 4. Column 4 provides the unmodified sequence of a sense strand suitable for use in a duplex described herein. Column 5 provides the position in the target mRNA (NM_001365536.1) of the sense strand of Column 4. Column 6 indicates the antisense sequence name. Column 7 indicates the sequence ID for the sequence of column 8. Column 8 provides the sequence of an antisense strand suitable for use in a duplex described herein, without specifying chemical modifications. Column 9 indicates the position in the target mRNA (NM_001365536.1) that is complementary to the antisense strand of Column 8.

| Duplex Name | Sense sequence name | Seq ID NO: (sense) | Sense sequence (5'-3') | mRNA target range in NM_001365536.1 | Antisense sequence name | Seq ID NO: (antisense) | antisense sequence (5'-3') | mRNA target range in NM_001365536.1 |
|---|---|---|---|---|---|---|---|---|
| AD-1251277.1 | A-2337459.1 | 5025 | CAACACAAUUUCUUCUUAGCA | 8498-8518 | A-2337461.1 | 5291 | UGCUAAGAAGAAAUUGUGUUGCC | 8496-8518 |
| AD-961334.3 | A-1812904.1 | 5026 | CAACACAATUTCUUCUUAGCA | 8498-8518 | A-1812905.1 | 5292 | UGCUAAGAAGAAATUGUGUUGUU | 8496-8518 |
| AD-1251278.1 | A-2337462.1 | 5027 | ACACAAUUUCUUCUUAGCA | 8500-8518 | A-2337463.1 | 5293 | UGCUAAGAAGAAAUUGUGUUG | 8498-8518 |
| AD-1251477.1 | A-1865763.1 | 5028 | GGCUUCAAGUGUUCCUACUGA | 9109-9129 | A-2337753.1 | 5294 | UCAGTAGGAACACUUGAAGCCGG | 9107-9129 |
| AD-1251478.1 | A-2337754.1 | 5029 | GCUUCAAGUGUUCCUACUGUA | 9100-9120 | A-2337755.1 | 5295 | UACAGUAGGAACACUUGAAGCCG | 9098-9120 |
| AD-1251479.1 | A-2337756.1 | 5030 | CUUCAAGUGUUCCUACUGUCA | 9101-9121 | A-2337757.1 | 5296 | UGACAGTAGGAACACUUGAAGCC | 9099-9121 |
| AD-1251481.1 | A-2337758.1 | 5031 | UUCAAGUGUUCCUACUGUCAA | 9102-9122 | A-2337760.1 | 5297 | UUGACAGUAGGAACACUUGAAGC | 9100-9122 |
| AD-1251480.1 | A-2337758.1 | 5032 | UUCAAGUGUUCCUACUGUCAA | 9102-9122 | A-2337759.1 | 5298 | UUGACAGUAGGAACACUUGAAGC | 9100-9122 |
| AD-1251482.1 | A-2337761.1 | 5033 | UCAAGUGUUCCUACUGUCAUA | 9103-9123 | A-2337762.1 | 5299 | UAUGACAGUAGGAACACUUGAGG | 9101-9123 |
| AD-1251483.1 | A-2337761.1 | 5034 | UCAAGUGUUCCUACUGUCAUA | 9103-9123 | A-2337763.1 | 5300 | UAUGACAGUAGGAACACUUGAGG | 9101-9123 |
| AD-1251492.1 | A-2337764.1 | 5035 | CAAGUGUUCCUACUGUCAUGA | 9104-9124 | A-2337773.1 | 5301 | UCAUGACAGUAGGAACACUUGCC | 9102-9124 |
| AD-1251485.1 | A-2337764.1 | 5036 | CAAGUGUUCCUACUGUCAUGA | 9104-9124 | A-2337766.1 | 5302 | UCAUGACAGUAGGAACACUUGGG | 9102-9124 |
| AD-802471.4 | A-1536717.1 | 5037 | CAAGUGUUCCUACUGUCAUGA | 9104-9124 | A-1536718.1 | 5303 | UCAUGACAGUAGGAACACUUGAA | 9102-9124 |

TABLE 13B-continued

Exemplary Human SCN9A Unmodified Single Strands and Duplex Sequences.
Column 1 indicates duplex name; the number following the decimal point in a duplex name merely refers to a batch production number. Column 2 indicates the sense sequence name. Column 3 indicates the sequence ID for the sequence of column 4. Column 4 provides the unmodified sequence of a sense strand suitable for use in a duplex described herein. Column 5 provides the position in the target mRNA (NM_001365536.1) of the sense strand of Column 4. Column 6 indicates the antisense sequence name. Column 7 indicates the sequence ID for the sequence of column 8. Column 8 provides the sequence of an antisense strand suitable for use in a duplex described herein, without specifying chemical modifications. Column 9 indicates the position in the target mRNA (NM_001365536.1) that is complementary to the antisense strand of Column 8.

| Duplex Name | Sense sequence name | Seq ID NO: (sense) | Sense sequence (5'-3') | mRNA target range in NM_001365536.1 | Antisense sequence name | Seq ID NO: (antisense) | antisense sequence (5'-3') | mRNA target range in NM_001365536.1 |
|---|---|---|---|---|---|---|---|---|
| AD-1251486.1 | A-2337764.1 | 5038 | CAAGUGUUCCUACUGUCAUGA | 9104-9124 | A-1536718.1 | 5304 | UCAUGACAGUAGGAACACUUGAA | 9102-9124 |
| AD-1251484.1 | A-2337764.1 | 5039 | CAAGUGUUCCUACUGUCAUGA | 9104-9124 | A-2337765.1 | 5305 | UCAUGACAGUAGGAACACUUGGG | 9102-9124 |
| AD-1251491.1 | A-2337764.1 | 5040 | CAAGUGUUCCUACUGUCAUGA | 9104-9124 | A-2337772.1 | 5306 | UCAUGACAGUAGGAACACUUGGG | 9102-9124 |
| AD-1251487.1 | A-2337764.1 | 5041 | CAAGUGUUCCUACUGUCAUGA | 9104-9124 | A-2337767.1 | 5307 | UCAUGACAGUAGGAACACUUGGG | 9102-9124 |
| AD-1251488.1 | A-2337764.1 | 5042 | CAAGUGUUCCUACUGUCAUGA | 9104-9124 | A-2337768.1 | 5308 | UCAUGACAGUAGGAACACUUGCC | 9102-9124 |
| AD-1251490.1 | A-2337764.1 | 5043 | CAAGUGUUCCUACUGUCAUGA | 9104-9124 | A-2337771.1 | 5309 | UCAUGACAGUAGGAACACUUGGG | 9102-9124 |
| AD-1251494.1 | A-2337775.1 | 5044 | AAGUGUUCCUACUGUCAUGAA | 9105-9125 | A-2337776.1 | 5310 | UUCATGACAGUAGGAACACUUGG | 9103-9125 |
| AD-1251493.1 | A-2337769.1 | 5045 | AGUGUUCCUACUGUCAUGA | 9106-9124 | A-2337774.1 | 5311 | UCAUGACAGUAGGAACACUUG | 9104-9124 |
| AD-1251489.1 | A-2337769.1 | 5046 | AGUGUUCCUACUGUCAUGA | 9106-9124 | A-2337770.1 | 5312 | UCAUGACAGUAGGAACACUUG | 9104-9124 |
| AD-1251495.1 | A-2337777.1 | 5047 | AGUGUUCCUACUGUCAUGACA | 9106-9126 | A-2337778.1 | 5313 | UGUCAUGACAGTAGGAACACUUG | 9104-9126 |
| AD-1251496.1 | A-2337779.1 | 5048 | GUGUUCCUACUGUCAUGACCA | 9107-9127 | A-2337780.1 | 5314 | UGGUCATGACAGUAGGAACACUU | 9105-9127 |
| AD-1251497.1 | A-2337781.1 | 5049 | UGUUCCUACUGUCAUGACCUA | 9108-9128 | A-2337782.1 | 5315 | UAGGTCAUGACAGUAGGAACACU | 9106-9128 |
| AD-1251498.1 | A-2337783.1 | 5050 | GUUCCUACUGUCAUGACCUGA | 9109-9129 | A-2337784.1 | 5316 | UCAGGUCAUGACAGUAGGAACGC | 9107-9129 |
| AD- | A- | 5051 | UUGAUAGUUACCUA | 9225-9245 | A- | 5317 | UGCAAACUAGGUAA | 9223-9245 |

TABLE 13B-continued

Exemplary Human SCN9A Unmodified Single Strands and Duplex Sequences.
Column 1 indicates duplex name; the number following the decimal point in a duplex name merely refers to a batch production number. Column 2 indicates the sense sequence name. Column 3 indicates the sequence ID for the sequence of column 4. Column 4 provides the unmodified sequence of a sense strand suitable for use in a duplex described herein. Column 5 provides the position in the target mRNA (NM_001365536.1) of the sense strand of Column 4. Column 6 indicates the antisense sequence name. Column 7 indicates the sequence ID for the sequence of column 8. Column 8 provides the sequence of an antisense strand suitable for use in a duplex described herein, without specifying chemical modifications. Column 9 indicates the position in the target mRNA (NM_001365536.1) that is complementary to the antisense strand of Column 8.

| Duplex Name | Sense sequence name | Seq ID NO: (sense) | Sense sequence (5'-3') | mRNA target range in NM_001365536.1 | Antisense sequence name | Seq ID NO: (antisense) | antisense sequence (5'-3') | mRNA target range in NM_001365536.1 |
|---|---|---|---|---|---|---|---|---|
| 802552.3 | 1536877.1 | | GUUUGCA | | 1536878.1 | | CUAUCAAAA | |
| AD-1251267.1 | A-2337439.1 | 5052 | UUGAUAGUTACCUA GUUUGCA | 9225-9245 | A-2337448.1 | 5318 | UGCAAACUAGGTAA CUAUCAAGG | 9223-9245 |
| AD-1251260.1 | A-2337439.1 | 5053 | UUGAUAGUTACCUA GUUUGCA | 9225-9245 | A-2337438.1 | 5319 | UGCAAACUAGGTAA CUAUCAAGG | 9223-9245 |
| AD-1251256.1 | A-2337433.1 | 5054 | UUGAUAGUUACCUA GUUUGCA | 9225-9245 | A-1536878.1 | 5320 | UGCAAACUAGGUAA CUAUCAAAA | 9223-9245 |
| AD-1251265.1 | A-2337436.1 | 5055 | UUGAUAGUUACCUA GUUUGCA | 9225-9245 | A-2337447.1 | 5321 | UGCAAACUAGGUAA CUAUCAAGG | 9223-9245 |
| AD-1251257.1 | A-2337434.1 | 5056 | UUGAUAGUUACCUA GUUUGCA | 9225-9245 | A-2337435.1 | 5322 | UGCAAACUAGGUAA CUAUCAAGG | 9223-9245 |
| AD-1251266.1 | A-2337437.1 | 5057 | UUGAUAGUUACCUA GUUUGCA | 9225-9245 | A-2337448.1 | 5323 | UGCAAACUAGGTAA CUAUCAAGG | 9223-9245 |
| AD-1251264.1 | A-2337445.1 | 5058 | UUGAUAGUUACCUA AUUUGCA | 9225-9245 | A-2337446.1 | 5324 | UGCAAATUAGGUAA CUAUCAAGG | |
| AD-1251259.1 | A-2337437.1 | 5059 | UUGAUAGUUACCUA GUUUGCA | 9225-9245 | A-2337438.1 | 5325 | UGCAAACUAGGTAA CUAUCAAGG | 9223-9245 |
| AD-1251258.1 | A-2337436.1 | 5060 | UUGAUAGUUACCUA GUUUGCA | 9225-9245 | A-2337435.1 | 5326 | UGCAAACUAGGUAA CUAUCAAGG | 9223-9245 |
| AD-1251263.1 | A-2337444.1 | 5061 | GAUAGUTACCUAGU UUGCA | 9227-9245 | A-2337443.1 | 5327 | UGCAAACUAGGTAA CUAUCGG | 9225-9245 |
| AD-1251262.1 | A-2337442.1 | 5062 | GAUAGUUACCUAGU UUGCA | 9227-9245 | A-2337443.1 | 5328 | UGCAAACUAGGTAA CUAUCGG | 9225-9245 |
| AD-1251261.1 | A-2337440.1 | 5063 | GAUAGUUACCUAGU UUGCA | 9227-9245 | A-2337441.1 | 5329 | UGCAAACUAGGUAA CUAUCGG | 9225-9245 |

TABLE 14A

Exemplary Human SCN9A siRNA Modified Single Strands and Duplex Sequences

Column 1 indicates duplex name and the number following the decimal point in a duplex name merely refers to a batch production number. Column 2 indicates the name of the sense sequence. Column 3 indicates the sequence ID for the sequence of column 4. Column 4 provides the modified sequence of a sense strand suitable for use in a duplex described herein. Column 5 indicates the antisense sequence name. Column 6 indicates the sequence ID for the sequence of column 7. Column 7 provides the sequence of a modified antisense strand suitable for use in a duplex described herein, e.g., a duplex comprising the sense sequence in the same row of the table. Column 8 indicates the position in the target mRNA (NM_001365536.1) that is complementary to the antisense strand of Column 7. Column 9 indicated the sequence ID for the sequence of column 8.

| Duplex Name | Sense sequence name | Seq ID NO: (sense) | Sense sequence (5'-3') | Antisense sequence name | Seq ID NO: (antisense) | Antisense sequence (5'-3') | mRNA target sequence in NM_001365536.1 | SEQ ID NO: (mRNA target) |
|---|---|---|---|---|---|---|---|---|
| AD-795305.2 | A-1522697.1 | 5330 | usgsucg(Ahd)GfuAfCfAfcuuuuacugaL96 | A-1522698.1 | 5346 | VPusCfsaguAfaAfAfguguAfcUfcgacasusu | AAUGUCGAGUACACUUUUACUGG | 5362 |
| AD-1251249.1 | A-2337423.1 | 5331 | usgsucgaguAfCfAfcuuu(Uhd)acugaL96 | A-2337424.1 | 5347 | VPusCfsagdTadAaaguguAfcUfcgacasusu | AAUGUCGAGUACACUUUUACUGG | 5363 |
| AD-1251251.1 | A-2337426.1 | 5332 | uscsgaguAfCfAfcuuu(Uhd)acugaL96 | A-2337427.1 | 5348 | VPusCfsagdTadAaaguguAfcUfcgascsg | UGUCGAGUACACUUUUACUGG | 5364 |
| AD-1010663.2 | A-1851796.1 | 5333 | usgsuag(Ghd)agdAadTucacuuuucaL96 | A-1875201.1 | 5349 | VPusdGsaadAadGugaadTudCudCcuacascsa | UGUGUAGGAGAAUUCACUUUUCU | 5365 |
| AD-1251301.1 | A-2337482.1 | 5334 | usgsuaggagdAaUfUfcac(Uhd)uuucaL96 | A-2337486.1 | 5350 | VPudGaadAa(G2p)ugaadTudCudCcuacascsg | UGUGUAGGAGAAUUCACUUUUCU | 5366 |
| AD-961179.3 | A-1812594.1 | 5335 | asasggg(Ahd)aadAcdAaucuuccguaL96 | A-1812595.1 | 5351 | VPusdAscgdGadAgauudGudTudTcccuususg | CAAAGGGAAAACAAUCUUCCGUU | 5367 |
| AD-1251317.1 | A-2337506.1 | 5336 | asasgggaaaAfCfAfaucu(Uhd)ccguaL96 | A-2337508.1 | 5352 | VPudAcgdGa(A2p)gauudGuUfudTcccuususg | CAAAGGGAAAACAAUCUUCCGUU | 5368 |
| AD-1251318.1 | A-2337509.1 | 5337 | asgsggaaAfaCfAfAfucuu(Chd)cguuaL96 | A-2337510.1 | 5353 | VPusAfsacdGgdAagauugUfuUfucccusus u | AAAGGGAAAACAAUCUUCCGUUU | 5369 |
| AD-1251323.1 | A-2337519.1 | 5338 | gsasaaa(Chd)aaUfCfUfuccguuucaaL96 | A-2337520.1 | 5354 | VPuUfgadAa(C2p)ggaagaUfudGuuuucscsc | GGGAAAACAAUCUUCCGUUUCAA | 5370 |
| AD-1251325.1 | A-2337523.1 | 5339 | asasaacaauCfUfUfccgu(Uhd)ucaaaL96 | A-2337524.1 | 5355 | VPuUfugdAadAcggadAgdAuUfguuuuscsc | GGAAAACAAUCUUCCGUUUCAAU | 5371 |
| AD-795634.3 | A-1523299.1 | 5340 | asgscau(Ahd)AfaUfGfUfuuucgaaauaL9 | A-1523300.1 | 5356 | VPusAfsuuuCfgAfAfaacaUfuUfaugcususc | GAAGCAUAAAUGUUUUCGAAAUU | 5372 |
| AD-1251363.1 | A-2337584.1 | 5341 | gsasagcauadAaUfguuu(Uhd)cgaaaL96 | A-2337585.1 | 5357 | VPuUfucdGadAaacadTuUfaUfgcuucsasg | CUGAAGCAUAAAUGUUUUCGAAA | 5373 |

TABLE 14A-continued

Exemplary Human SCN9A siRNA Modified Single Strands and Duplex Sequences
Column 1 indicates duplex name and the number following the decimal point in a duplex name merely refers to a batch production number. Column 2 indicates the name of the sense sequence. Column 3 indicates the sequence ID for the sequence of column 4. Column 4 provides the modified sequence of a sense strand suitable for use in a duplex described herein. Column 5 indicates the antisense sequence name. Column 6 indicates the sequence ID for the sequence of column 7. Column 7 provides the sequence of a modified antisense strand suitable for use in a duplex described herein, e.g., a duplex comprising the sense sequence in the same row of the table. Column 8 indicates the position in the target mRNA (NM_001365536.1) that is complementary to the antisense strand of Column 7. Column 9 indicated the sequence ID for the sequence of column 8.

| Duplex Name | Sense sequence name | Seq ID NO: (sense) | Sense sequence (5'-3') | Antisense sequence name | Seq ID NO: (antisense) | Antisense sequence (5'-3') | mRNA target sequence in NM_001365536.1 | SEQ ID NO: (mRNA target) |
|---|---|---|---|---|---|---|---|---|
| AD-1251364.1 | A-1812604.1 | 5342 | asasgca(Uhd)aadAudGuuuucgaaaaL96 | A-2337586.1 | 5358 | VPuUfuudCgdAaaacdAuUfudAugcuuscsg | UGAAGCAUAAAUGUUUUCGAAAU | 5374 |
| AD-1251373.1 | A-2337591.1 | 5343 | asgscauaaaUfgUfuuu(Chd)gaaauaL96 | A-2337599.1 | 5359 | VPudAuudTc(G2p)aaaadCaUfuUfaugcuscsc | GAAGCAUAAAUGUUUUCGAAAUU | 5375 |
| AD-1251385.1 | A-1523845.1 | 5344 | asusgau(Chd)UfuCfUfUfugucguaguaL96 | A-2337618.1 | 5360 | VPudAcudAcdGacaadAgdAadGaucausgsu | ACAUGAUCUUCUUUGUCGUAGUG | 5376 |
| AD-1251391.1 | A-2337625.1 | 5345 | uscsu(Uhd)CfuUfudGucguagugaaL96 | A-2337626.1 | 5361 | VPusUfscadCu(Agn)cgacdAaAfgAfagasusc | GAUCUUCUUUGUCGUAGUGAU | 5377 |

TABLE 14B

Exemplary Human SCN9A Unmodified Single Strands and Duplex Sequences.
Column 1 indicates duplex name; the number following the decimal point in a duplex name merely refers to a batch production number. Column 2 indicates the sense sequence name. Column 3 indicates the sequence ID for the sequence of column 4. Column 4 provides the unmodified sequence of a sense strand suitable for use in a duplex described herein. Column 5 provides the position in the target mRNA (NM_001365536.1) of the sense strand of Column 4. Column 6 indicates the antisense sequence name. Column 7 indicates the sequence ID for the sequence of column 8. Column 8 provides the sequence of an antisense strand suitable for use in a duplex described herein, without specifying chemical modifications. Column 9 indicates the position in the target mRNA (NM_001365536.1) that is complementary to the antisense strand of Column 8.

| Duplex Name | Sense sequence name | Seq ID NO: (sense) | Sense sequence (5'-3') | mRNA target range in NM_001365536.1 | Antisense sequence name | Seq ID NO: (antisense) | antisense sequence (5'-3') | mRNA target range in NM_001365536.1 |
|---|---|---|---|---|---|---|---|---|
| AD-795305.2 | A-1522697.1 | 5378 | UGUCGAGUACACUUUUACUGA | 760-780 | A-1522698.1 | 5394 | UCAGUAAAAGUGUACUCGACAUU | 758-780 |
| AD-1251249.1 | A-2337423.1 | 5379 | UGUCGAGUACACUUUUACUGA | 760-780 | A-2337424.1 | 5395 | UCAGTAAAAGUGUACUCGACAUU | 758-780 |
| AD-1251251.1 | A-2337426.1 | 5380 | UCGAGUACACUUUUACUGA | 762-780 | A-2337427.1 | 5396 | UCAGTAAAAGUGUACUCGACG | 760-780 |
| AD-1010663.2 | A-1851796.1 | 5381 | UGUAGGAGAATUCACUUUUCA | 872-892 | A-1875201.1 | 5397 | UGAAAAGUGAATUCUCCUACACA | 870-892 |
| AD-1251301.1 | A-2337482.1 | 5382 | UGUAGGAGAAUUCACUUUUCA | 829-849 | A-2337486.1 | 5398 | UGAAAAGUGAATUCUCCUACACG | 827-849 |
| AD-961179.3 | A-1812594.1 | 5383 | AAGGGAAAACAAUCUUCCGUA | 576-596 | A-1812595.1 | 5399 | UACGGAAGAUUGUTUTCCCUUUG | 574-596 |
| AD-1251317.1 | A-2337506.1 | 5384 | AAGGGAAAACAAUCUUCCGUA | 576-596 | A-2337508.1 | 5400 | UACGGAAGAUUGUUUTCCCUUUG | 574-596 |
| AD-1251318.1 | A-2337509.1 | 5385 | AGGGAAAACAAUCUUCCGUUA | 577-597 | A-2337510.1 | 5401 | UAACGGAAGAUUGUUUUCCCUUU | 575-597 |
| AD-1251323.1 | A-2337519.1 | 5386 | GAAAACAAUCUUCCGUUUCAA | 580-600 | A-2337520.1 | 5402 | UUGAAACGGAAGAUUGUUUUCCC | 578-600 |
| AD-1251325.1 | A-2337523.1 | 5387 | AAAACAAUCUUCCGUUUCAAA | 581-601 | A-2337524.1 | 5403 | UUUGAAACGGAAGAUUGUUUUCC | 579-601 |
| AD-795634.3 | A-1523299.1 | 5388 | AGCAUAAAUGUUUUCGAAAUA | 1113-1133 | A-1523300.1 | 5404 | UAUUUCGAAAACAUUUAUGCUUC | 1111-1133 |
| AD-1251363.1 | A-2337584.1 | 5389 | GAAGCAUAAAUGUUUUCGAAA | 1111-1131 | A-2337585.1 | 5405 | UUUCGAAAACATUUAUGCUUCAG | 1109-1131 |
| AD-1251364.1 | A-1812604.1 | 5390 | AAGCAUAAAUGUUUUCGAAAA | 1112-1132 | A-2337586.1 | 5406 | UUUUCGAAAACAUUUAUGCUUCG | 1110-1132 |

TABLE 14B-continued

Exemplary Human SCN9A Unmodified Single Strands and Duplex Sequences.
Column 1 indicates duplex name; the number following the decimal point in a duplex name merely refers to a batch production number. Column 2 indicates the sense sequence name. Column 3 indicates the sequence ID for the sequence of column 4. Column 4 provides the unmodified sequence of a sense strand suitable for use in a duplex described herein. Column 5 provides the position in the target mRNA (NM_001365536.1) of the sense strand of Column 4. Column 6 indicates the antisense sequence name. Column 7 indicates the sequence ID for the sequence of column 8. Column 8 provides the sequence of an antisense strand suitable for use in a duplex described herein, without specifying chemical modifications. Column 9 indicates the position in the target mRNA (NM_001365536.1) that is complementary to the antisense strand of Column 8.

| Duplex Name | Sense sequence name | Seq ID NO: (sense) | Sense sequence (5'-3') | mRNA target range in NM_001365536.1 | Antisense sequence name | Seq ID NO: (antisense) | antisense sequence (5'-3') | mRNA target range in NM_001365536.1 |
|---|---|---|---|---|---|---|---|---|
| AD-1251373.1 | A-2337591.1 | 5391 | AGCAUAAAUGUUUUCGAAAUA | 1113-1133 | A-2337599.1 | 5407 | UAUUTCGAAAACAUUUAUGCUCC | 1111-1133 |
| AD-1251385.1 | A-1523845.1 | 5392 | AUGAUCUUCUUUGUCGUAGUA | 1433-1453 | A-2337618.1 | 5408 | UACUACGACAAAGAAGAUCAUGU | 1431-1453 |
| AD-1251391.1 | A-2337625.1 | 5393 | UCUUCUUUGUCGUAGUGAA | 1437-1455 | A-2337626.1 | 5409 | UUCACUACGACAAAGAAGAUC | 1435-1455 |

TABLE 15A

Exemplary Human SCN9A siRNA Modified Single Strands and Duplex Sequences
Column 1 indicates duplex name and the number following the decimal point in a duplex name merely refers to a batch production number. Column 2 indicates the name of the sense sequence. Column 3 indicates the sequence ID for the sequence of column 4. Column 4 provides the modified sequence of a sense strand suitable for use in a duplex described herein. Column 5 indicates the antisense sequence name. Column 6 indicates the sequence ID for the sequence of column 7. Column 7 provides the sequence of a modified antisense strand suitable for use in a duplex described herein, e.g., a duplex comprising the sense sequence in the same row of the table. Column 8 indicates the position in the target mRNA (NM_001365536.1) that is complementary to the antisense strand of Column 7. Column 9 indicated the sequence ID for the sequence of column 8.

| Duplex Name | Sense sequence name | Seq ID NO: (sense) | Sense sequence (5'-3') | Antisense sequence name | Seq ID NO: (anti sense) | Antisense sequence (5'-3') | mRNA target sequence in NM_001365536.1 | SEQ ID NO: (mRNA target) |
|---|---|---|---|---|---|---|---|---|
| AD-1251492.2 | A-2337764.1 | 5410 | csasagugUfuCfCfUfacug(Uhd)caugaL96 | A-2337773.1 | 5426 | VPuCfaudGa(C2p)aguaggAfaCfacuugscsc | UUCAAGUGUUCCUACUGUCAUGA | 5442 |
| AD-961334.2 | A-1812904.1 | 5411 | csasaca(Chd)aadTudTcuucuuagcaL96 | A-1812905.1 | 5427 | VPusdGscudAadGaagadAadTudGuguugsusU | AACAACACAAUUUCUUCUUAGCA | 5443 |
| AD-1251279.2 | A-2337459.1 | 5412 | csasaca(Chd)aaUfUfUfcuucuuagcaL96 | A-2337464.1 | 5428 | VPudGcudAadGaagadAaUfudGuguugsusu | AACAACACAAUUUCUUCUUAGCA | 5444 |
| AD-1251284.2 | A-2337423.1 | 5413 | usgsucgaguAfCfAfcuuu(Uhd)acugaL96 | A-2337467.1 | 5429 | VPusCfsagdTadAaagudGuAfcdTcgacasusu | AAUGUCGAGUACACUUUUACUGG | 5445 |
| AD-1251334.2 | A-2337536.1 | 5414 | ususcug(Uhd)guAfgdGagaauucacaL96 | A-2337538.1 | 5430 | VPusdGsugdAa(U2p)ucucdCuAfcAfcagaasgsc | GCUUCUGUGUAGGAGAAUUCACU | 5446 |
| AD-1251377.2 | A-2337604.1 | 5415 | asusaaa(Uhd)guUfUfUfcgaaauucaaL96 | A-2337606.1 | 5431 | VPusUfsgadAudTucgaaaAfcAfuuuausgsu | GCAUAAAUGUUUUCGAAAUUCAC | 5447 |
| AD-1251398.2 | A-2337622.1 | 5416 | gsasucu(Uhd)CfuUfudGucguagugaaL96 | A-2337630.1 | 5432 | VPuUfcadCu(A2p)cgacdAaAfgAfagaucsgsu | AUGAUCUUCUUUGUCGUAGUGAU | 5448 |
| AD-1251399.2 | A-2337628.1 | 5417 | gsasucu(Uhd)CfuUfudGUfcguagugaaL96 | A-2337630.1 | 5433 | VPuUfcadCu(A2p)cgacdAaAfgAfagaucsgsu | AUGAUCUUCUUUGUCGUAGUGAU | 5449 |
| AD-961188.2 | A-1812612.1 | 5418 | csasuga(Uhd)cudTcdTuugucguagaL96 | A-1812613.1 | 5434 | VPusdCsuadCgdAcaaadGadAgdAucaugsusa | UACAUGAUCUUCUUUGUCGUAGU | 5450 |
| AD-1251274.3 | A-2337449.1 | 5419 | csasuga(Uhd)cuUfCfUfuugucguagaL96 | A-2337457.1 | 5435 | VPuCfuadCgdAcaaadGadAgdAucaugsusg | UACAUGAUCUUCUUUGUCGUAGU | 5451 |
| AD-796825.2 | A-1525636.1 | 5420 | ususugu(Ahd)GfaUfCfUfugcaauuacaL96 | A-1257916.1 | 5436 | VPusGfsuaaUfuGfCfaagaUfcUfacaaasasg | CUUUUGUAGAUCUUGCAAUUACC | 5452 |
| AD- | A- | 5421 | ususuug(Uhd)agAfU | A- | 5437 | VPusUfsaadTu(G2p)c | | |

TABLE 15A-continued

Exemplary Human SCN9A siRNA Modified Single Strands and Duplex Sequences
Column 1 indicates duplex name and the number following the decimal point in a duplex name merely refers to a batch production number. Column 2 indicates the name of the sense sequence. Column 3 indicates the sequence ID for the sequence of column 4. Column 4 provides the modified sequence of a sense strand suitable for use in a duplex described herein. Column 5 indicates the antisense sequence name. Column 6 indicates the sequence ID for the sequence of column 7. Column 7 provides the sequence of a modified antisense strand suitable for use in a duplex described herein, e.g., a duplex comprising the sense sequence in the same row of the table. Column 8 indicates the position in the target mRNA (NM_001365536.1) that is complementary to the antisense strand of Column 7. Column 9 indicated the sequence ID for the sequence of column 8.

| Duplex Name | Sense sequence name | Seq ID NO: (sense) | Sense sequence (5'-3') | Antisense sequence name | Seq ID NO: (anti sense) | Antisense sequence (5'-3') | mRNA target sequence in NM_001365536.1 | SEQ ID NO: (mRNA target) |
|---|---|---|---|---|---|---|---|---|
| 1251411.2 | 2337650.1 | | fCfuugcaauuaaL96 | 2337651.1 | | aagauCfuAfcaaagscsc | | |
| AD-1251419.2 | A-2337662.1 | 5422 | gsusaga(Uhd)CfuUfgCfaauuaccauaL96 | A-2337663.1 | 5438 | VPudAugdGudAauugdCaAfgAfucuacsgsg | UUGUAGAUCUUGCAAUUACCAUU | 5454 |
| AD-797564.3 | A-1527042.1 | 5423 | usasugu(Ghd)AfaAfCfAfaaccuuacgaL96 | A-1527043.1 | 5439 | VPusCfsguaAfgGfUfuuguUfuCfacauasasu | AUUAUGUGAAACAAACCUUACGU | 5455 |
| AD-1251428.2 | A-2337677.1 | 5424 | ususaug(Uhd)gaAfAfCfaaaccuuacaL96 | A-2337678.1 | 5440 | VPudGuadAg(G2p)uuuguuUfcAfcauaasusu | AAUUAUGUGAAACAAACCUUACG | 5456 |
| AD-1251434.2 | A-2337679.1 | 5425 | usasugugAfaAfCfAfaacc(Uhd)uacgaL96 | A-2337687.1 | 5441 | VPuCfgudAa(G2p)guuuguUfuCfacauasgsu | AUUAUGUGAAACAAACCUUACGU | 5457 |

TABLE 15B

Exemplary Human SCN9A Unmodified Single Strands and Duplex Sequences.
Column 1 indicates duplex name; the number following the decimal point in a duplex name merely refers to a batch production number. Column 2 indicates the sense sequence name. Column 3 indicates the sequence ID for the sequence of column 4. Column 4 provides the unmodified sequence of a sense strand suitable for use in a duplex described herein. Column 5 provides the position in the target mRNA (NM_001365536.1) of the sense strand of Column 4. Column 6 indicates the antisense sequence name. Column 7 indicates the sequence ID for the sequence of column 8. Column 8 provides the sequence of an antisense strand suitable for use in a duplex described herein, without specifying chemical modifications. Column 9 indicates the position in the target mRNA (NM_001365536.1) that is complementary to the antisense strand of Column 8.

| Duplex Name | Sense sequence name | Seq ID NO: (sense) | Sense sequence (5'-3') | mRNA target range in NM_001365536.1 | Antisense sequence name | Seq ID NO: (antisense) | antisense sequence (5'-3') | mRNA target range in NM_001365536.1 |
|---|---|---|---|---|---|---|---|---|
| AD-1251492.2 | A-2337764.1 | 5458 | CAAGUGUUCCUACUGUCAUGA | 9104-9124 | A-2337773.1 | 5474 | UCAUGACAGUAGGAACACUUGCC | 9102-9124 |
| AD-961334.2 | A-1812904.1 | 5459 | CAACACAATUTCUUCUUAGCA | 8498-8518 | A-1812905.1 | 5475 | UGCUAAGAAGAAATUGUGUUGUU | 8496-8518 |
| AD-1251279.2 | A-2337459.1 | 5460 | CAACACAAUUUCUUCUUAGCA | 8498-8518 | A-2337464.1 | 5476 | UGCUAAGAAGAAAUUGUGUUGUU | 8496-8518 |
| AD-1251284.2 | A-2337423.1 | 5461 | UGUCGAGUACACUUUUACUGA | 760-780 | A-2337467.1 | 5477 | UCAGTAAAAGUGUACTCGACAUU | 758-780 |
| AD-1251334.2 | A-2337536.1 | 5462 | UUCUGUGUAGGAGAAUUCACA | 824-844 | A-2337538.1 | 5478 | UGUGAAUUCUCCUACACAGAAGC | 822-844 |
| AD-1251377.2 | A-2337604.1 | 5463 | AUAAAUGUUUUCGAAAUUCAA | 1116-1136 | A-2337606.1 | 5479 | UUGAAUTUCGAAAACAUUUAUGU | 1114-1136 |
| AD-1251398.2 | A-2337622.1 | 5464 | GAUCUUCUUUGUCGUAGUGAA | 1435-1455 | A-2337630.1 | 5480 | UUCACUACGACAAAGAAGAUCGU | 1433-1455 |
| AD-1251399.2 | A-2337628.1 | 5465 | GAUCUUCUUUGUCGUAGUGAA | 1435-1455 | A-2337630.1 | 5481 | UUCACUACGACAAAGAAGAUCGU | 1433-1455 |
| AD-961188.2 | A-1812612.1 | 5466 | CAUGAUCUTCTUUGUCGUAGA | 1432-1452 | A-1812613.1 | 5482 | UCUACGACAAAGAAGAUCAUGUA | 1430-1452 |
| AD-1251274.3 | A-2337449.1 | 5467 | CAUGAUCUUCUUUGUCGUAGA | 1432-1452 | A-2337457.1 | 5483 | UCUACGACAAAGAAGAUCAUGUG | 1430-1452 |
| AD-796825.2 | A-1525636.1 | 5468 | UUUGUAGAUCUUGCAAUUACA | 2531-2551 | A-1257916.1 | 5484 | UGUAAUUGCAAGAUCUACAAAAG | 2529-2551 |
| AD-1251411.2 | A-2337650.1 | 5469 | UUUUGUAGAUCUUGCAAUUAA | 2530-2550 | A-2337651.1 | 5485 | UUAATUGCAAGAUCUACAAAGCC | |
| AD-1251419.2 | A-2337662.1 | 5470 | GUAGAUCUUGCAAUUACCAUA | 2534-2554 | A-2337663.1 | 5486 | UAUGGUAAUUGCAAGAUCUACGG | 2532-2554 |

TABLE 15B-continued

Exemplary Human SCN9A Unmodified Single Strands and Duplex Sequences.
Column 1 indicates duplex name; the number following the decimal point in a duplex name merely refers to a batch production number. Column 2 indicates the sense sequence name. Column 3 indicates the sequence ID for the sequence of column 4. Column 4 provides the unmodified sequence of a sense strand suitable for use in a duplex described herein. Column 5 provides the position in the target mRNA (NM_001365536.1) of the sense strand of Column 4. Column 6 indicates the antisense sequence name. Column 7 indicates the sequence ID for the sequence of column 8. Column 8 provides the sequence of an antisense strand suitable for use in a duplex described herein, without specifying chemical modifications. Column 9 indicates the position in the target mRNA (NM_001365536.1) that is complementary to the antisense strand of Column 8.

| Duplex Name | Sense sequence name | Seq ID NO: (sense) | Sense sequence (5'-3') | mRNA target range in NM_001365536.1 | Antisense sequence name | Seq ID NO: (antisense) | antisense sequence (5'-3') | mRNA target range in NM_001365536.1 |
|---|---|---|---|---|---|---|---|---|
| AD-797564.3 | A-1527042.1 | 5471 | UAUGUGAAACAAACCUUACGA | 3299-3319 | A-1527043.1 | 5487 | UCGUAAGGUUUGUUUCACAUAAU | 3297-3319 |
| AD-1251428.2 | A-2337677.1 | 5472 | UUAUGUGAAACAAACCUUACA | 3298-3318 | A-2337678.1 | 5488 | UGUAAGGUUUGUUUCACAUAAUU | 3296-3318 |
| AD-1251434.2 | A-2337679.1 | 5473 | UAUGUGAAACAAACCUUACGA | 3299-3319 | A-2337687.1 | 5489 | UCGUAAGGUUUGUUUCACAUAGU | 3297-3319 |

TABLE 16

SCN9A Lipid-Conjugated Modified Sequences.
The C16 modifications shown are exemplary modifications. It is understood other lipophilic moieties may be used at other locations within the duplex as provided above.

| Duplex Name | Modified sense strand sequence | SEQ ID NO: | Modified antisense strand sequence | SEQ ID NO: |
|---|---|---|---|---|
| AD-1479539 | gscscca(Ahd)AfaUfAfCfugauaauasgsa | 5490 | VPusCfsuauUfaUfCfaguaUfuUfugggcsasg | 5645 |
| AD-1479540 | asasggg(Ahd)AfaAfCfAfaucuuccgsusa | 5491 | VPusAfscggAfaGfAfuuguUfuUfcccuususg | 5646 |
| AD-1479541 | ususugu(Ahd)gadTcdTugcaauuascsa | 5492 | VPusdGsuadAudTgcaadGadTcdTacaaasasg | 5647 |
| AD-1479542 | asusguc(Ghd)AfgUfAfCfacuuuuacsusa | 5493 | VPusAfsguaAfaAfGfuguaCfuCfgacaususu | 5648 |
| AD-1479543 | csusaaa(Uhd)UfaUfGfGfaaguaaucsusa | 5494 | VPusAfsgauUfaCfUfuccaUfaAfuuuagsgsa | 5649 |
| AD-1479544 | usgsaga(Chd)UfgAfCfAfcauuguaasusa | 5495 | VPusAfsuuaCfaAfUfguguCfaGfucucasasg | 5650 |
| AD-1479545 | asuscuu(Chd)uudTgdTcguagugasusa | 5496 | VPusdAsucdAcdTacgadCadAadGaagauscsa | 5651 |
| AD-1479546 | usgsguu(Uhd)CfaGfCfAfcagauucasgsa | 5497 | VPusCfsugaAfuCfUfgugcUfgAfaaccascsa | 5652 |
| AD-1479547 | ascsaug(Ahd)ucdTudCuuugucgusasa | 5498 | VPusdTsacdGadCaaagdAadGadTcaugusasg | 5653 |
| AD-1479548 | csusucu(Ghd)AfaAfCfAfuccaaacusgsa | 5499 | VPusCfsaguUfuGfGfauguUfuCfagaagsasa | 5654 |
| AD-1479549 | usasuug(Uhd)GfaCfUfUfuaaguuuasgsa | 5500 | VPusCfsuaaAfcUfUfaaagUfcAfcaauasasg | 5655 |
| AD-1479550 | csasccu(Uhd)CfuCfCfUfuaaaauucsusa | 5501 | VPusAfsgaaUfuUfUfaaggAfgAfaggugsasc | 5656 |
| AD-1479551 | ususgug(Ahd)CfuUfUfAfaguuuagusgsa | 5502 | VPusCfsacuAfaAfCfuuaaAfgUfcacaasusa | 5657 |
| AD-1479552 | gsasucu(Uhd)cudTudGucguagugsasa | 5503 | VPusdTscadCudAcgacdAadAgdAagaucsasu | 5658 |
| AD-1479553 | ususgcu(Ahd)UfaGfGfAfaauuuggucsa | 5504 | VPusGfsaccAfaAfUfuuccUfaUfagcaasgsu | 5659 |
| AD-1479554 | csasuga(Uhd)CfuUfCfUfuugucguasgsa | 5505 | VPusCfsuacGfaCfAfaagaAfgAfucaugsusa | 5660 |
| AD-1479555 | ususgau(Ahd)GfuUfAfCfcuaguuugscsa | 5506 | VPusGfscaaAfcUfAfgguaAfcUfaucaasasa | 5661 |
| AD-1479556 | ususcug(Uhd)GfuAfGfGfagaauucascsa | 5507 | VPusGfsugaa(Tgn)ucuccuAfcAfcagaasgsc | 5662 |
| AD-1479557 | usgscua(Uhd)agdGadAauuuggucsusa | 5508 | VPusdAsgadCcdAaauudTcdCudAuagcasasg | 5663 |
| AD-1479558 | ususcug(Uhd)gudAgdGagaauucascsa | 5509 | VPusdGsugdAadTucucdCudAcdAcagaasgsc | 5664 |
| AD-1479559 | usgsaua(Ghd)UfuAfCfCfuaguuugcsasa | 5510 | VPusUfsgcaAfaCfUfagguAfaCfuaucasasa | 5665 |
| AD-1479560 | gsusuug(Ahd)AfcAfCfAfaaucuuucsgsa | 5511 | VPusCfsgaaAfgAfUfuuguGfuUfcaaacscsu | 5666 |
| AD-1479561 | gsasgau(Ghd)GfaUfUfCfucuucguuscsa | 5512 | VPusGfsaacGfaAfGfagaaUfcCfaucucscsc | 5667 |
| AD-1479562 | asusgau(Chd)UfuCfUfUfugucguagsusa | 5513 | VPusAfscuaCfgAfCfaaagAfaGfaucausgsu | 5668 |
| AD-1479563 | asgscuu(Ghd)AfaGfUfAfaaauuagascsa | 5514 | VPusGfsucuAfaUfUfuuacUfuCfaagcususa | 5669 |
| AD-1479564 | asuscuu(Chd)UfuUfGfUfcguagugasusa | 5515 | VPusAfsucaCfuAfCfgacaAfaGfaagauscsa | 5670 |
| AD-1479565 | usgsauc(Uhd)ucdTudTgucguagusgsa | 5516 | VPusdCsacdTadCgacadAadGadAgaucasusg | 5671 |
| AD-1479566 | asuscug(Ahd)gadCudGaauuugccsgsa | 5517 | VPusdCsggdCadAauucdAgdTcdTcagauscsc | 5672 |
| AD-1479567 | asusgau(Chd)uudCudTugucguagsusa | 5518 | VPusdAscudAcdGacaadAgdAadGaucausgsu | 5673 |
| AD-1479568 | csasagu(Ghd)UfuCfCfUfacugucausgsa | 5519 | VPusCfsaugAfcAfGfuaggAfaCfacuugsasa | 5674 |
| AD-1479569 | asusgug(Ahd)AfaCfAfAfaccuuacgsusa | 5520 | VPusAfscguAfaGfGfuuugUfuUfcacausasa | 5675 |
| AD-1479570 | usgsucg(Ahd)gudAcdAcuuuuacusgsa | 5521 | VPusdCsagdTadAaagudGudAcdTcgacasusu | 5676 |
| AD-1479571 | usgsuag(Ghd)AfgAfAfUfucacuuuuscsa | 5522 | VPusGfsaaaAfgUfGfaauuCfuCfcuacascsa | 5677 |
| AD-1479572 | gsgscgu(Uhd)GfuAfGfUfuccuaucuscsa | 5523 | VPusGfsagaUfaGfGfaacuAfcAfacgccsusu | 5678 |
| AD-1479573 | usasuug(Uhd)gadCudTuaaguuuasgsa | 5524 | VPusdCsuadAadCuuaadAgdTcdAcaauasasg | 5679 |
| AD-1479574 | ususgug(Ahd)cudTudAaguuuagusgsa | 5525 | VPusdCsacdTadAacuudAadAgdTcacaasusa | 5680 |

TABLE 16-continued

SCN9A Lipid-Conjugated Modified Sequences.
The C16 modifications shown are exemplary modifications. It is understood other lipophilic moieties may be used at other locations within the duplex as provided above.

| Duplex Name | Modified sense strand sequence | SEQ ID NO: | Modified antisense strand sequence | SEQ ID NO: |
|---|---|---|---|---|
| AD-1209344 | csasaca(Chd)aadTudTcuucuuagscsa | 5526 | VPusdGscudAadGaagadAadTudGuguugsusu | 5681 |
| AD-1479575 | asasggg(Ahd)aadAcdAaucuuccgsusa | 5527 | VPusdAscgdGadAgauudGudTudTcccuususg | 5682 |
| AD-1331347 | usgsucg(Ahd)GfuAfCfAfcuuuuacusgsa | 5528 | VPusCfsaguAfaAfAfguguAfcUfcgacasusu | 5683 |
| AD-1479576 | gsasucu(Uhd)CfuUfUfGfucguagugsasa | 5529 | VPusUfscacUfaCfGfacaaAfgAfagaucsasu | 5684 |
| AD-1443073 | asgscau(Ahd)AfaUfGfUfuuucgaaasusa | 5530 | VPusAfsuuuCfgAfAfaacaUfuUfaugcususc | 5685 |
| AD-1479577 | usasugu(Ghd)AfaAfCfAfaaccuuacsgsa | 5531 | VPusCfsguaAfgGfUfuuguUfuCfacauasasu | 5686 |
| AD-1479578 | usgsuag(Ghd)agdAadTucacuuuuscsa | 5532 | VPusdGsaadAadGugaadTudCudCcuacascsa | 5687 |
| AD-1479579 | csasuga(Uhd)cudTcdTuugucguasgsa | 5533 | VPusdCsuadCgdAcaaadGadAgdAucaugsusa | 5688 |
| AD-1183928 | ususcug(Uhd)GfuAfGfGfagaauucascsa | 5534 | VPusGfsugaAfuUfCfuccuAfcAfcagaasgsc | 5689 |
| AD-1183930 | ususugu(Ahd)GfaUfCfUfugcaauuascsa | 5535 | VPusGfsuaaUfuGfCfaagaUfcUfacaaasasg | 5690 |
| AD-1331355 | usgsucgaguAfCfAfcuuu(Uhd)acusgsa | 5536 | VPusCfsagdTadAaaguguAfcUfcgacasusu | 5691 |
| AD-1479580 | uscsgaguAfCfAfcuuu(Uhd)acusgsa | 5537 | VPusCfsagdTadAaaguguAfcUfcgascsg | 5692 |
| AD-1331354 | csasuga(Uhd)cuUfCfUfuugucguasgsa | 5538 | VPuCfuadCgdAcaaadGadAgdAucaugsusg | 5693 |
| AD-1479581 | gsasaaa(Chd)aaUfCfUfuccauuucsasa | 5539 | VPuUfgadAadTggaagaUfudGuuuucscsc | 5694 |
| AD-1331351 | gsasaaa(Chd)aaUfCfUfuccguuucsasa | 5540 | VPuUfgadAa(C2p)ggaagaUfudGuuuucscsc | 5695 |
| AD-1479582 | asasaacaAfuCfUfUfccgu(Uhd)ucasasa | 5541 | VPusUfsugdAadAcggaagAfuUfguuuuscsc | 5696 |
| AD-1331350 | asasaacaauCfUfUfccgu(Uhd)ucasasa | 5542 | VPuUfugdAadAcggadAgdAuUfguuuuscsc | 5697 |
| AD-1479583 | gsgscuu(Chd)UfgUfgUfaggagaausgsa | 5543 | VPudAaudTc(Tgn)ccuadCaCfadGaagccsusc | 5698 |
| AD-1479584 | ususcug(Uhd)guAfgdGagaauucascsa | 5544 | VPusdGsugdAa(U2p)ucucdCuAfcAfcagaasg sc | 5699 |
| AD-1479585 | gsusguaggadGadAuuca(Chd)uuusgsa | 5545 | VPudAaadAgdTgaaudTcUfcCfuacacsgsg | 5700 |
| AD-1479586 | usgsuaggagdAaUfucau(Uhd)uuuscsa | 5546 | VPusdGsaadAadAugaadTuCfuCfcuacascsg | 5701 |
| AD-1479587 | gsgsagaaUfuCfAfCfuuuu(Chd)uucsgsa | 5547 | VPusCfsgadAgdAaaagugAfaUfucuccsusg | 5702 |
| AD-1479588 | gsgsagaaUfuCfaCfuuuu(Chd)uucsgsa | 5548 | VPuCfgadAgdAaaagdTgdAaUfucuccsusg | 5703 |
| AD-1479589 | csusgaagCfaUfAfAfaugu(Uhd)uucsgsa | 5549 | VPusCfsgadAadAcauuuaUfgCfuucagsgsu | 5704 |
| AD-1479590 | usgsaag(Chd)audAadAuguuuucgsasa | 5550 | VPuUfcgdAadAacaudTuAfudGcuucasgsg | 5705 |
| AD-1479591 | gsasagcaUfaAfAfUfguuu(Uhd)cgasasa | 5551 | VPusUfsucdGadAaacauuUfaUfgcuucsasg | 5706 |
| AD-1331349 | gsasagcauadAaUfguuu(Uhd)cgasasa | 5552 | VPuUfucdGadAaacadTuUfaUfgcuucsasg | 5707 |
| AD-1479592 | asasgca(Uhd)aadAudGuuuucgaasasa | 5553 | VPuUfuudCgdAaaacdAuUfudAugcuuscsg | 5708 |
| AD-1479593 | asgsca(Uhd)aaaUfgUfuuucgaaasusa | 5554 | VPudAuudTcdGaaaadCaUfuUfaugcususc | 5709 |
| AD-1479594 | asgscauaAfaUfGfUfuuu(Chd)gaaasusa | 5555 | VPusAfsuuuCfgAfAfaacaUfuUfaugcususc | 5710 |
| AD-1479595 | asgscauaAfaUfGfUfuuu(Chd)gaaasusa | 5556 | VPusAfsuudTc(G2p)aaaacaUfuUfaugcususc | 5711 |
| AD-1479596 | asgscauaaaUfgUfuuu(Uhd)gaaasusa | 5557 | VPusAfsuudTcdAaaaadCaUfuUfaugcususc | 5712 |
| AD-1479597 | asgscauaaaUfgUfuuu(Chd)gaaasusa | 5558 | VPusdAsuudTc(G2p)aaaadCaUfuUfaugcusc sc | 5713 |
| AD-1479598 | csasuaaaUfgUfuuu(Chd)gaaasusa | 5559 | VPusdAsuudTc(G2p)aaaadCaUfuUfaugscsu | 5714 |
| AD-1479599 | asgscauaaaUfgUfuuu(Chd)gaaasusa | 5560 | VPudAuudTc(G2p)aaaadCaUfuUfaugcususc | 5715 |

TABLE 16-continued

SCN9A Lipid-Conjugated Modified Sequences.
The C16 modifications shown are exemplary modifications. It is understood other lipophilic moieties may be used at other locations within the duplex as provided above.

| Duplex Name | Modified sense strand sequence | SEQ ID NO: | Modified antisense strand sequence | SEQ ID NO: |
|---|---|---|---|---|
| AD-1479600 | gscsa(Uhd)aaaugUfUfuucgaaaususa | 5561 | VPusdAsaudTu(C2p)gaaaacAfuUfuaugcsusu | 5716 |
| AD-1479601 | asusaaa(Uhd)guUfUfUfcgaaauucsasa | 5562 | VPusUfsgadAudTucgaaaAfcAfuuuausgsc | 5717 |
| AD-1479602 | asusaaa(Uhd)guUfUfUfcgaaauucsasa | 5563 | VPusUfsgadAudTucgaaaAfcAfuuuausgsu | 5718 |
| AD-1479603 | usasaaugUfuUfuCfgaaa(Uhd)ucascsa | 5564 | VPudGugdAadTuucgdAadAaCfauuuasusg | 5719 |
| AD-1479604 | usasca(Uhd)gAfuCfUfUfcuuugucgsusa | 5565 | VPusAfscgdAcdAaagaagAfuCfauguasgsg | 5720 |
| AD-1479605 | csasuga(Uhd)CfuUfCfUfuugucguasgsa | 5566 | VPusCfsuadCgdAcaaagaAfgAfucaugsusg | 5721 |
| AD-1479606 | csasuga(Uhd)CfuUfCfUfuugucguasgsa | 5567 | VPuCfuadCgdAcaaadGadAgdAucaugsusg | 5722 |
| AD-1331348 | asusgau(Chd)UfuCfUfUfugucguagsusa | 5568 | VPudAcudAcdGacaadAgdAadGaucausgsu | 5723 |
| AD-1479607 | usgsauc(Uhd)UfcUfUfUfgucguagusgsa | 5569 | VPudCacdTadCgacadAadGadAgaucasusg | 5724 |
| AD-1479608 | uscsu(Uhd)CfuUfudGucguagugsasa | 5570 | VPusUfscadCu(Agn)cgacdAaAfgAfagasusc | 5725 |
| AD-1479609 | uscsu(Uhd)CfuUfudGucguagugsasa | 5571 | VPusUfscadCu(A2p)cgacdAaAfgAfagasusc | 5726 |
| AD-1443072 | gsasucu(Uhd)CfuUfudGucguagugsasa | 5572 | VPuUfcadCu(A2p)cgacdAaAfgAfagaucsgsu | 5727 |
| AD-1479610 | gsasucu(Uhd)CfuUfudGUfcguagugsasa | 5573 | VPuUfcadCu(A2p)cgacdAaAfgAfagaucsgsu | 5728 |
| AD-1479611 | gsasucu(Uhd)CfuUfUfgUfCfguagugsasa | 5574 | VPuUfcadCu(A2p)cgacaaAfgAfagaucsgsu | 5729 |
| AD-1479612 | uscsuuugUfcgUfAfguga(Uhd)uuuscsa | 5575 | VPudGaadAadTcacudAcdGaCfaaagasgsg | 5730 |
| AD-1479613 | asusccu(Uhd)UfugUfAfgaucuugcsasa | 5576 | VPusUfsgcdAa(G2p)aucuacAfaAfaggauscsc | 5731 |
| AD-1479614 | cscsuuu(Uhd)gudAgdAucuugcaasusa | 5577 | VPudAuudGc(A2p)agaudCuAfcAfaaaggsgsu | 5732 |
| AD-1479615 | csusuuugUfagAfUfcuug(Chd)aaususa | 5578 | VPusAfsaudTg(C2p)aagaucUfaCfaaaagsgsg | 5733 |
| AD-1479616 | ususuug(Uhd)AfgAfUfCfuugcaauusasa | 5579 | VPusUfsaadTu(G2p)caagauCfuAfcaaaasgsg | 5734 |
| AD-1479617 | ususuug(Uhd)agAfUfCfuugcaauusasa | 5580 | VPusUfsaadTu(G2p)caagauCfuAfcaaagscsc | 5735 |
| AD-1479618 | ususug(Uhd)agaUfCfUfugcaauuascsa | 5581 | VPusGfsuaaUfuGfCfaagaUfcUfacaaasgsg | 5736 |
| AD-1479619 | ususug(Uhd)agaUfCfUfugcaauuascsa | 5582 | VPusdGsuadAu(Tgn)gcaagaUfcUfacaaasgsg | 5737 |
| AD-1479620 | ususug(Uhd)agaUfCfUfugcaauuascsa | 5583 | VPudGuadAu(Tgn)gcaagaUfcUfacaaasgsg | 5738 |
| AD-1479621 | ususguagauCfUfUfgcaa(Uhd)uacscsa | 5584 | VPusdGsgudAa(U2p)ugcaagAfuCfuacaasgsg | 5739 |
| AD-1479622 | gsusaga(Uhd)CfuUfgCfaauuaccasusa | 5585 | VPudAugdGudAauugdCaAfgAfucuacsgsg | 5740 |
| AD-1479623 | asasuua(Uhd)gudGadAacaaaccususa | 5586 | VPudAagdGu(U2p)uguudTcAfcAfuaauusug | 5741 |
| AD-1479624 | asusuaugugdAadAcaaa(Chd)cuusasa | 5587 | VPuUfaadGg(Tgn)uugudTuCfaCfauaausu | 5742 |
| AD-1479625 | ususaug(Uhd)gaAfAfCfaaaccuuascsa | 5588 | VPudGuadAg(G2p)uuuguuUfcAfcauaasusu | 5743 |
| AD-1331354 | csasuga(Uhd)cuUfCfUfuugucguasgsa | 5589 | VPuCfuadCgdAcaaadGadAgdAucaugsusg | 5744 |
| AD-1479581 | gsasaaa(Chd)aaUfCfUfuccauuucsasa | 5590 | VPuUfgadAadTggaagaUfudGuuucscsc | 5745 |
| AD-1331351 | gsasaaa(Chd)aaUfCfUfuccguuucsasa | 5591 | VPuUfgadAa(C2p)ggaagaUfudGuuucscsc | 5746 |
| AD-1331350 | asasaacaauCfUfUfccgu(Uhd)ucasasa | 5592 | VPuUfugdAadAcggadAgdAuUfguuuuscsc | 5747 |
| AD-1479583 | gsgscuu(Chd)UfgUfgUfaggagaaususa | 5593 | VPudAaudTc(Tgn)ccuadCaCfadGaagccsusc | 5748 |
| AD-1479585 | gsusguaggadGadAuuca(Chd)uuususa | 5594 | VPudAaadAgdTgaaudTcUfcCfuacacsgsg | 5749 |
| AD-1479588 | gsgsagaaUfuCfaCfuuuu(Chd)uucsgsa | 5595 | VPuCfgadAgdAaaagdTgdAaUfucuccsusg | 5750 |
| AD-1479590 | usgsaag(Chd)audAadAuguuuucgsasa | 5596 | VPuUfcgdAadAacaudTuAfudGcuucasgsg | 5751 |

TABLE 16-continued

SCN9A Lipid-Conjugated Modified Sequences.
The C16 modifications shown are exemplary modifications. It is understood other lipophilic moieties may be used at other locations within the duplex as provided above.

| Duplex Name | Modified sense strand sequence | SEQ ID NO: | Modified antisense strand sequence | SEQ ID NO: |
|---|---|---|---|---|
| AD-1331349 | gsasagcauadAaUfguuu(Uhd)cgasasa | 5597 | VPuUfucdGadAaacadTuUfaUfgcuucsasg | 5752 |
| AD-1479592 | asasgca(Uhd)aadAudGuuuucgaasasa | 5598 | VPuUfuudCgdAaaacdAuUfudAugcuuscsg | 5753 |
| AD-1479593 | asgsca(Uhd)aaaUfgUfuuucgaaasusa | 5599 | VPudAuudTcdGaaaadCaUfuUfaugcususc | 5754 |
| AD-1479599 | asgscauaaaUfgUfuuu(Chd)gaaasusa | 5600 | VPudAuudTc(G2p)aaaadCaUfuUfaugcususc | 5755 |
| AD-1479603 | usasaaugUfuUfuCfgaaa(Uhd)ucascsa | 5601 | VPudGugdAadTuucgdAadAaCfauuuasusg | 5756 |
| AD-1479606 | csasuga(Uhd)CfuUfCfUfuugucguasgsa | 5602 | VPuCfuadCgdAcaaadGadAgdAucaugsusg | 5757 |
| AD-1331348 | asusgau(Chd)UfuCfUfUfugucguagsusa | 5603 | VPudAcudAcdGacaadAgdAadGaucausgsu | 5758 |
| AD-1479607 | usgsauc(Uhd)UfcUfUfUfgucguagusgsa | 5604 | VPudCacdTadCgacadAadGadAgaucasusg | 5759 |
| AD-1443072 | gsasucu(Uhd)CfuUfudGucguagugsasa | 5605 | VPuUfcadCu(A2p)cgacdAaAfgAfagaucsgsu | 5760 |
| AD-1479610 | gsasucu(Uhd)CfuUfudGUfcguagugsasa | 5606 | VPuUfcadCu(A2p)cgacdAaAfgAfagaucsgsu | 5761 |
| AD-1479611 | gsasucu(Uhd)CfuUfUfgUfCfguagugsasa | 5607 | VPuUfcadCu(A2p)cgacaaAfgAfagaucsgsu | 5762 |
| AD-1479612 | uscsuuugUfcgUfAfguga(Uhd)uuuscsa | 5608 | VPudGaadAadTcacudAcdGaCfaaagasgsg | 5763 |
| AD-1479614 | cscsuuu(Uhd)gudAgdAucuugcaasusa | 5609 | VPudAuudGc(A2p)agaudCuAfcAfaaaggsgsu | 5764 |
| AD-1479620 | ususug(Uhd)agaUfCfUfugcaauuascsa | 5610 | VPudGuadAu(Tgn)gcaagaUfcUfacaaasgsg | 5765 |
| AD-1479622 | gsusaga(Uhd)CfuUfgCfaauuaccasusa | 5611 | VPudAugdGudAauugdCaAfgAfucuacsgsg | 5766 |
| AD-1479623 | asasuua(Uhd)gudGadAacaaaccususa | 5612 | VPudAagdGu(U2p)uguudTcAfcAfuaauus.sg | 5767 |
| AD-1479624 | asusuaugugdAadAcaaa(Chd)cuusasa | 5613 | VPuUfaadGg(Tgn)uugudTuCfaCfauaausus.u | 5768 |
| AD-1479625 | ususaug(Uhd)gaAfAfCfaaaccuuascsa | 5614 | VPudGuadAg(G2p)uuuguuUfcAfcauaasusu | 5769 |
| AD-1481938 | gsusaga(Uhd)CfuUfgCfaauuaccasusa | 5615 | VPusdAsugdGudAauugdCaAfgAfucuacsgsg | 5770 |
| AD-1481939 | asasuua(Uhd)gudGadAacaaaccususa | 5616 | VPusdAsagdGu(U2p)uguudTcAfcAfuaauusu sg | 5771 |
| AD-1481940 | asusuaugugdAadAcaaa(Chd)cuusasa | 5617 | VPusUfsaadGg(Tgn)uugudTuCfaCfauaausu su | 5772 |
| AD-1481941 | ususaug(Uhd)gaAfAfCfaaaccuuascsa | 5618 | VPusdGsuadAg(G2p)uuuguuUfcAfcauaasusu | 5773 |
| AD-1481942 | csasuga(Uhd)cuUfCfUfuugucguasgsa | 5619 | VPusCfsuadCgdAcaaadGadAgdAucaugsusg | 5774 |
| AD-1481943 | gsasaaa(Chd)aaUfCfUfuccauuucsasa | 5620 | VPusUfsgadAadTggaagaUfudGuuucscsc | 5775 |
| AD-1481944 | gsasaaa(Chd)aaUfCfUfuccguuucsasa | 5621 | VPusUfsgadAa(C2p)ggaagaUfudGuuucscsc | 5776 |
| AD-1481945 | asasaacaauCfUfUfccgu(Uhd)ucasasa | 5622 | VPusUfsugdAadAcggadAgdAuUfguuuscsc | 5777 |
| AD-1481946 | gsgscuu(Chd)UfgUfgUfaggagaaususa | 5623 | VPusdAsaudTc(Tgn)ccuadCaCfadGaagccsu sc | 5778 |
| AD-1481947 | gsusguaggadGadAuuca(Chd)uuususa | 5624 | VPusdAsaadAgdTgaaudTcUfcCfuacacsgsg | 5779 |
| AD-1481948 | gsgsagaaUfuCfaCfuuuu(Chd)uucsgsa | 5625 | VPusCfsgadAgdAaaagdTgdAaUfucuccsusg | 5780 |
| AD-1481949 | usgsaag(Chd)audAadAuguuuucgsasa | 5626 | VPusIIfscgdAadAacaudTuAfudGcuucasgsg | 5781 |
| AD-1481950 | gsasagcauadAaUfguuu(Uhd)cgasasa | 5627 | VPusUfsucdGadAaacadTuUfaUfgcuucsasg | 5782 |
| AD-1481951 | asasgca(Uhd)aadAudGuuuucgaasasa | 5628 | VPusUfsuudCgdAaaacdAuUfudAugcuuscsg | 5783 |
| AD-1481952 | asgsca(Uhd)aaaUfgUfuuucgaaasusa | 5629 | VPusdAsuudTcdGaaaadCaUfuUfaugcususc | 5784 |
| AD-1481953 | asgscauaaaUfgUfuuu(Chd)gaaasusa | 5630 | VPusdAsuudTc(G2p)aaaadCaUfuUfaugcusu sc | 5785 |

TABLE 16-continued

SCN9A Lipid-Conjugated Modified Sequences.
The C16 modifications shown are exemplary modifications. It is understood other lipophilic moieties may be used at other locations within the duplex as provided above.

| Duplex Name | Modified sense strand sequence | SEQ ID NO: | Modified antisense strand sequence | SEQ ID NO: |
|---|---|---|---|---|
| AD-1481954 | usasaaugUfuUfuCfgaaa(Uhd)ucascsa | 5631 | VPusdGsugdAadTuucgdAadAaCfauuuasusg | 5786 |
| AD-1481955 | csasuga(Uhd)CfuUfCfUfuugucguasgsa | 5632 | VPusCfsuadCgdAcaaadGadAgdAucaugsusg | 5787 |
| AD-1481956 | asusgau(Chd)UfuCfUfUfugucguagsusa | 5633 | VPusdAscudAcdGacaadAgdAadGaucausgsu | 5788 |
| AD-1481957 | usgsauc(Uhd)UfcUfUfUfgucguagusgsa | 5634 | VPusdCsacdTadCgacadAadGadAgaucasusg | 5789 |
| AD-1481958 | gsasucu(Uhd)CfuUfudGucguagugsasa | 5635 | VPusUfscadCu(A2p)cgacdAaAfgAfagaucsg su | 5790 |
| AD-1481959 | gsasucu(Uhd)CfuUfudGUfcguagugsasa | 5636 | VPusUfscadCu(A2p)cgacdAaAfgAfagaucsg su | 5791 |
| AD-1481960 | gsasucu(Uhd)CfuUfUfgUfCfguagugsasa | 5637 | VPusUfscadCu(A2p)cgacaaAfgAfagaucsgsu | 5792 |
| AD-1481961 | uscsuuugUfcgUfAfguga(Uhd)uuuscsa | 5638 | VPusdGsaadAadTcacudAcdGaCfaaagasgsg | 5793 |
| AD-1481962 | cscsuuu(Uhd)gudAgdAucuugcaasusa | 5639 | VPusdAsuudGc(A2p)agaudCuAfcAfaaaggsg su | 5794 |
| AD-1479619 | ususug(Uhd)agaUfCfUfugcaauuascsa | 5640 | VPusdGsuadAu(Tgn)gcaagaUfcUfacaaasgsg | 5795 |
| AD-1481938 | gsusaga(Uhd)CfuUfgCfaauuaccasusa | 5641 | VPusdAsugdGudAauugdCaAfgAfucuacsgsg | 5796 |
| AD-1481939 | asasuua(Uhd)gudGadAacaaaccususa | 5642 | VPusdAsagdGu(U2p)uguudTcAfcAfuaauusu sg | 5797 |
| AD-1481940 | asusuaugugdAadAcaaa(Chd)cuusasa | 5643 | VPusUfsaadGg(Tgn)uugudTuCfaCfauaausu su | 5798 |
| AD-1481941 | ususaug(Uhd)gaAfAfCfaaaccuuascsa | 5644 | VPusdGsuadAg(G2p)uuuguuUfcAfcauaasusu | 5799 |
| AD-1331352 | usgsucgaguAfCfAfcuuu(Uhd)acusgsa | 5800 | VPusCfsagdTadAaagudGuAfcdTcgacasusu | 5801 |

Example 2. In Vitro Screening of SCN9A siRNA

Experimental Methods

Dual-Glo® Luciferase Assay

Hepa1-6 cells (ATCC) were grown to near confluence at 37° C. in an atmosphere of 5% $CO_2$ in DMEM (ATCC) supplemented with 10% FBS, before being released from the plate by trypsinization. A single-dose experiment was performed at 10 nM final duplex concentration. Three different siRNA and psiCHECK2-SCN9A plasmid transfections were carried out with each plasmid containing the 3' untranslated region (UTR). The three plasmids were referred to as SCN9A-1, SCN9A-2, and SCN9A-3. Transfection was carried out by adding 10 nM of siRNA duplexes and 30-75 ng of one of the three psiCHECK2-SCN9A plasmids per well along with 4.9 μL of Opti-MEM plus 0.5 μL of Lipofectamine 2000 per well (Invitrogen, Carlsbad CA cat #13778-150) and then incubated at room temperature for 15 minutes. The mixture was then added to the cells (approximately 15,000 per well), which were re-suspended in 35 μL of fresh complete media. The transfected cells were incubated at 37° C. in an atmosphere of 5% $CO_2$.

Twenty-four hours after the siRNAs and psiCHECK2-SCN9A plasmid were transfected; Firefly (transfection control) and *Renilla* (fused to SCN9A target sequence) luciferase were measured. First, media was removed from cells. Then Firefly luciferase activity was measured by adding 20 μL of Dual-Glo® Luciferase Reagent (Promega) equal to the culture medium volume to each well and mixing. The mixture was incubated at room temperature for 30 minutes before luminescence (500 nm) was measured on a Spectramax (Molecular Devices) to detect the Firefly luciferase signal. *Renilla* luciferase activity was measured by adding 20 μL of room temperature of Dual-Glo® Stop & Glo® Reagent (Promega) were added to each well and the plates were incubated for 10-15 minutes before luminescence was again measured to determine the *Renilla* luciferase signal. The Dual-Glo® Stop & Glo® Reagent quenched the firefly luciferase signal and sustained luminescence for the *Renilla* luciferase reaction. siRNA activity was determined by normalizing the *Renilla* (SCN9A) signal to the Firefly (control) signal within each well. The magnitude of siRNA activity was then assessed relative to cells that were transfected with the same vector but were not treated with siRNA or were treated with a non-SCN9A targeting siRNA. All transfections are done with n=4.

Results

The results of the single-dose dual luciferase screen in Hepa1-6 cells transfected with either the SCN9A-1 (added at 30 ng/well), SCN9A-2 (added at 75 ng/well), or SCN9A-3 plasmid (added at 30 ng/well) and treated with an exemplary set of SCN9A siRNAs is shown in Table 3 (correspond to siRNAs in Table 2A). The single-dose experiment was performed at a 10 nM final duplex concentration and the data are expressed as percent SCN9A luciferase signal remaining relative to cells treated with a non-targeting control.

Of the siRNA duplexes evaluated in cells transfected with SCN9A-1, 2 achieved ≥80% knockdown of SCN9A, 34 achieved ≥60% knockdown of SCN9A, 92 achieved ≥30% knockdown of SCN9A, and 95 achieved ≥20% knockdown of SCN9A.

Of the siRNA duplexes evaluated in cells transfected with SCN9A-2, 9 achieved ≥80% knockdown of SCN9A, 90 achieved ≥60% knockdown of SCN9A, 130 achieved ≥30% knockdown of SCN9A, and 132 achieved ≥20% knockdown of SCN9A.

Of the siRNA duplexes evaluated in cells transfected with SCN9A-3, 7 achieved ≥60% knockdown of SCN9A, 34 achieved ≥30% knockdown of SCN9A, and 47 achieved ≥20% knockdown of SCN9A.

TABLE 3

SCN9A in vitro dual luciferase 10 nM screen with one set of exemplary human SCN9A siRNAs

| | | 10 nM | |
|---|---|---|---|
| Duplex ID* | Plasmid | % of SCN9A Luciferase signal Remaining | StDev |
| AD-887232.1 | SCN9A-1 | 93.8 | 0.080 |
| AD-887233.1 | | 20.6 | 0.038 |
| AD-887234.1 | | 42.8 | 0.086 |
| AD-887235.1 | | 20.6 | 0.035 |
| AD-887236.1 | | 21.9 | 0.037 |
| AD-887237.1 | | 24.8 | 0.018 |
| AD-887238.1 | | 57.6 | 0.040 |
| AD-887239.1 | | 28.7 | 0.014 |
| AD-887240.1 | | 60.8 | 0.043 |
| AD-887241.1 | | 35.2 | 0.014 |
| AD-887242.1 | | 58.7 | 0.092 |
| AD-887243.1 | | 65.6 | 0.099 |
| AD-887244.1 | | 23.7 | 0.019 |
| AD-887245.1 | | 15.9 | 0.020 |
| AD-887246.1 | | 20.4 | 0.022 |
| AD-887247.1 | | 20.1 | 0.018 |
| AD-887248.1 | | 19.9 | 0.011 |
| AD-887249.1 | | 24.1 | 0.045 |
| AD-887250.1 | | 31.5 | 0.039 |
| AD-887251.1 | | 27.1 | 0.040 |
| AD-887252.1 | | 22.4 | 0.026 |
| AD-887253.1 | | 23.1 | 0.015 |
| AD-887254.1 | | 24.6 | 0.033 |
| AD-887255.1 | | 44.5 | 0.072 |
| AD-887256.1 | | 51.4 | 0.082 |
| AD-887257.1 | | 21.8 | 0.025 |
| AD-887258.1 | | 51.7 | 0.124 |
| AD-887259.1 | | 30.2 | 0.046 |
| AD-887260.1 | | 26.8 | 0.043 |
| AD-887261.1 | | 27.9 | 0.030 |
| AD-887262.1 | | 33.3 | 0.094 |
| AD-887263.1 | | 40.6 | 0.042 |
| AD-887264.1 | | 31.2 | 0.047 |
| AD-887265.1 | | 37.0 | 0.045 |
| AD-887266.1 | | 44.5 | 0.131 |
| AD-887267.1 | | 46.4 | 0.059 |
| AD-887268.1 | | 36.7 | 0.035 |
| AD-887269.1 | | 35.2 | 0.038 |
| AD-887270.1 | | 34.1 | 0.046 |
| AD-887271.1 | | 71.6 | 0.036 |
| AD-887272.1 | | 49.4 | 0.018 |
| AD-887273.1 | | 50.6 | 0.041 |
| AD-887274.1 | | 36.7 | 0.099 |
| AD-887275.1 | | 89.3 | 0.041 |
| AD-887276.1 | | 49.8 | 0.036 |
| AD-887277.1 | | 97.5 | 0.152 |
| AD-887278.1 | | 49.3 | 0.052 |
| AD-887279.1 | | 86.3 | 0.086 |
| AD-887280.1 | | 45.5 | 0.025 |
| AD-887281.1 | | 42.7 | 0.086 |
| AD-887282.1 | | 105.3 | 0.240 |
| AD-887283.1 | | 121.4 | 0.208 |
| AD-887284.1 | | 82.6 | 0.116 |

TABLE 3-continued

SCN9A in vitro dual luciferase 10 nM screen with one set of exemplary human SCN9A siRNAs

| | | 10 nM | |
|---|---|---|---|
| Duplex ID* | Plasmid | % of SCN9A Luciferase signal Remaining | StDev |
| AD-887285.1 | | 54.7 | 0.147 |
| AD-887286.1 | | 122.0 | 0.057 |
| AD-887287.1 | | 44.2 | 0.090 |
| AD-887288.1 | | 40.7 | 0.026 |
| AD-887289.1 | | 54.0 | 0.083 |
| AD-887290.1 | | 51.4 | 0.094 |
| AD-887291.1 | | 52.5 | 0.112 |
| AD-887292.1 | | 37.5 | 0.061 |
| AD-887293.1 | | 41.8 | 0.083 |
| AD-887294.1 | | 103.6 | 0.109 |
| AD-887295.1 | | 46.0 | 0.100 |
| AD-887296.1 | | 60.7 | 0.049 |
| AD-887297.1 | | 42.3 | 0.072 |
| AD-887298.1 | | 47.6 | 0.035 |
| AD-887299.1 | | 65.9 | 0.068 |
| AD-887300.1 | | 89.9 | 0.040 |
| AD-887301.1 | | 66.6 | 0.078 |
| AD-887302.1 | | 59.6 | 0.053 |
| AD-887303.1 | | 31.3 | 0.032 |
| AD-887304.1 | | 37.5 | 0.055 |
| AD-887305.1 | | 73.2 | 0.056 |
| AD-887306.1 | | 35.5 | 0.021 |
| AD-887307.1 | | 36.7 | 0.032 |
| AD-887308.1 | | 97.6 | 0.098 |
| AD-887309.1 | | 60.5 | 0.066 |
| AD-887310.1 | | 45.8 | 0.018 |
| AD-887311.1 | | 40.8 | 0.037 |
| AD-887312.1 | | 44.9 | 0.113 |
| AD-887313.1 | | 48.3 | 0.077 |
| AD-887314.1 | | 45.3 | 0.056 |
| AD-887315.1 | | 44.2 | 0.029 |
| AD-887316.1 | | 55.0 | 0.054 |
| AD-887317.1 | | 51.3 | 0.045 |
| AD-887318.1 | | 55.8 | 0.053 |
| AD-887319.1 | | 44.2 | 0.020 |
| AD-887320.1 | | 50.9 | 0.060 |
| AD-887321.1 | | 50.3 | 0.093 |
| AD-887322.1 | | 104.1 | 0.129 |
| AD-887323.1 | | 99.3 | 0.064 |
| AD-887324.1 | | 94.8 | 0.083 |
| AD-887325.1 | | 36.2 | 0.063 |
| AD-887326.1 | | 42.4 | 0.033 |
| AD-887327.1 | | 57.2 | 0.104 |
| AD-887328.1 | | 57.9 | 0.036 |
| AD-887329.1 | | 65.0 | 0.124 |
| AD-887330.1 | | 61.0 | 0.026 |
| AD-887331.1 | | 89.2 | 0.079 |
| AD-887332.1 | | 44.3 | 0.078 |
| AD-887333.1 | | 42.7 | 0.135 |
| AD-887334.1 | | 57.7 | 0.035 |
| AD-887335.1 | | 59.8 | 0.088 |
| AD-887336.1 | | 75.3 | 0.098 |
| AD-887337.1 | | 47.5 | 0.080 |
| AD-887338.1 | | 51.8 | 0.056 |
| AD-887339.1 | | 60.2 | 0.068 |
| AD-887340.1 | | 126.3 | 0.223 |
| AD-887341.1 | | 109.1 | 0.127 |
| AD-887342.1 | | 53.1 | 0.101 |
| AD-887343.1 | | 55.3 | 0.042 |
| AD-887344.1 | SCN9A-2 | 13.5 | 0.039 |
| AD-887345.1 | | 21.4 | 0.006 |
| AD-887346.1 | | 13.0 | 0.026 |
| AD-887347.1 | | 27.0 | 0.041 |
| AD-887348.1 | | 34.9 | 0.039 |
| AD-887349.1 | | 13.6 | 0.045 |
| AD-887350.1 | | 18.4 | 0.033 |
| AD-887351.1 | | 12.8 | 0.021 |
| AD-887352.1 | | 14.6 | 0.034 |
| AD-887353.1 | | 84.0 | 0.081 |
| AD-887354.1 | | 12.8 | 0.028 |
| AD-887355.1 | | 25.5 | 0.051 |
| AD-887356.1 | | 17.7 | 0.040 |

TABLE 3-continued

SCN9A in vitro dual luciferase 10 nM screen with one set of exemplary human SCN9A siRNAs

| Duplex ID* | Plasmid | 10 nM % of SCN9A Luciferase signal Remaining | StDev |
|---|---|---|---|
| AD-887357.1 | | 17.3 | 0.009 |
| AD-887358.1 | | 22.6 | 0.033 |
| AD-887359.1 | | 35.0 | 0.032 |
| AD-887360.1 | | 23.8 | 0.048 |
| AD-887361.1 | | 21.7 | 0.026 |
| AD-887362.1 | | 21.5 | 0.027 |
| AD-887363.1 | | 25.6 | 0.044 |
| AD-887364.1 | | 33.5 | 0.038 |
| AD-887365.1 | | 28.2 | 0.037 |
| AD-887366.1 | | 25.6 | 0.015 |
| AD-887367.1 | | 23.4 | 0.028 |
| AD-887368.1 | | 21.5 | 0.033 |
| AD-887369.1 | | 30.8 | 0.032 |
| AD-887370.1 | | 28.8 | 0.034 |
| AD-887371.1 | | 27.6 | 0.050 |
| AD-887372.1 | | 27.0 | 0.053 |
| AD-887373.1 | | 39.0 | 0.042 |
| AD-887374.1 | | 78.8 | 0.037 |
| AD-887375.1 | | 37.0 | 0.056 |
| AD-887376.1 | | 30.0 | 0.069 |
| AD-887377.1 | | 28.1 | 0.032 |
| AD-887378.1 | | 20.8 | 0.025 |
| AD-887379.1 | | 26.2 | 0.023 |
| AD-887380.1 | | 39.9 | 0.086 |
| AD-887381.1 | | 34.5 | 0.007 |
| AD-887382.1 | | 25.5 | 0.027 |
| AD-887383.1 | | 29.2 | 0.040 |
| AD-887384.1 | | 27.2 | 0.043 |
| AD-887385.1 | | 33.6 | 0.044 |
| AD-887386.1 | | 29.4 | 0.020 |
| AD-887387.1 | | 28.8 | 0.060 |
| AD-887388.1 | | 45.3 | 0.087 |
| AD-887389.1 | | 32.6 | 0.062 |
| AD-887390.1 | | 27.0 | 0.055 |
| AD-887391.1 | | 43.3 | 0.039 |
| AD-887392.1 | | 35.7 | 0.019 |
| AD-887393.1 | | 30.5 | 0.017 |
| AD-887394.1 | | 33.3 | 0.022 |
| AD-887395.1 | | 32.9 | 0.051 |
| AD-887396.1 | | 39.5 | 0.028 |
| AD-887397.1 | | 33.7 | 0.040 |
| AD-887398.1 | | 37.0 | 0.020 |
| AD-887399.1 | | 36.5 | 0.069 |
| AD-887400.1 | | 42.4 | 0.042 |
| AD-887401.1 | | 44.3 | 0.074 |
| AD-887402.1 | | 35.2 | 0.070 |
| AD-887403.1 | | 35.7 | 0.027 |
| AD-887404.1 | | 45.5 | 0.126 |
| AD-887405.1 | | 37.8 | 0.065 |
| AD-887406.1 | | 36.6 | 0.064 |
| AD-887407.1 | | 37.9 | 0.036 |
| AD-887408.1 | | 41.0 | 0.049 |
| AD-887409.1 | | 39.5 | 0.044 |
| AD-887410.1 | | 47.0 | 0.031 |
| AD-887411.1 | | 39.3 | 0.014 |
| AD-887412.1 | | 34.6 | 0.052 |
| AD-887413.1 | | 42.1 | 0.057 |
| AD-887414.1 | | 34.1 | 0.051 |
| AD-887415.1 | | 32.0 | 0.036 |
| AD-887416.1 | | 34.1 | 0.032 |
| AD-887417.1 | | 35.4 | 0.041 |
| AD-887418.1 | | 42.5 | 0.078 |
| AD-887419.1 | | 46.2 | 0.067 |
| AD-887420.1 | | 53.0 | 0.047 |
| AD-887421.1 | | 37.1 | 0.025 |
| AD-887422.1 | | 38.0 | 0.099 |
| AD-887423.1 | | 29.6 | 0.038 |
| AD-887424.1 | | 44.5 | 0.077 |
| AD-887425.1 | | 50.5 | 0.065 |
| AD-887426.1 | | 49.4 | 0.026 |
| AD-887427.1 | | 38.5 | 0.067 |
| AD-887428.1 | | 34.0 | 0.033 |

TABLE 3-continued

SCN9A in vitro dual luciferase 10 nM screen with one set of exemplary human SCN9A siRNAs

| Duplex ID* | Plasmid | 10 nM % of SCN9A Luciferase signal Remaining | StDev |
|---|---|---|---|
| AD-887429.1 | | 33.5 | 0.035 |
| AD-887430.1 | | 33.4 | 0.046 |
| AD-887431.1 | | 25.2 | 0.045 |
| AD-887432.1 | | 43.8 | 0.055 |
| AD-887433.1 | | 34.8 | 0.043 |
| AD-887434.1 | | 67.0 | 0.075 |
| AD-887435.1 | | 49.0 | 0.021 |
| AD-887436.1 | | 35.6 | 0.099 |
| AD-887437.1 | | 36.8 | 0.076 |
| AD-887438.1 | | 34.1 | 0.096 |
| AD-887439.1 | | 32.6 | 0.031 |
| AD-887440.1 | | 37.9 | 0.016 |
| AD-887441.1 | | 35.9 | 0.065 |
| AD-887442.1 | | 46.6 | 0.085 |
| AD-887443.1 | | 40.5 | 0.027 |
| AD-887444.1 | | 42.6 | 0.028 |
| AD-887445.1 | | 63.9 | 0.129 |
| AD-887446.1 | | 41.0 | 0.105 |
| AD-887447.1 | | 56.1 | 0.053 |
| AD-887448.1 | | 37.8 | 0.101 |
| AD-887449.1 | | 38.8 | 0.041 |
| AD-887450.1 | | 45.4 | 0.057 |
| AD-887451.1 | | 61.1 | 0.024 |
| AD-887452.1 | | 36.3 | 0.034 |
| AD-887453.1 | | 40.6 | 0.028 |
| AD-887454.1 | | 45.3 | 0.081 |
| AD-887455.1 | | 42.7 | 0.097 |
| AD-887456.1 | | 36.1 | 0.068 |
| AD-887457.1 | | 54.0 | 0.057 |
| AD-887458.1 | | 45.0 | 0.056 |
| AD-887459.1 | | 55.9 | 0.041 |
| AD-887460.1 | | 37.2 | 0.023 |
| AD-887461.1 | | 70.7 | 0.120 |
| AD-887462.1 | | 63.4 | 0.050 |
| AD-887463.1 | | 28.7 | 0.015 |
| AD-887464.1 | | 39.9 | 0.043 |
| AD-887465.1 | | 30.2 | 0.046 |
| AD-887466.1 | | 43.0 | 0.056 |
| AD-887467.1 | | 27.8 | 0.032 |
| AD-887468.1 | | 27.2 | 0.021 |
| AD-887469.1 | | 49.1 | 0.052 |
| AD-887470.1 | | 39.3 | 0.067 |
| AD-887471.1 | | 46.1 | 0.074 |
| AD-887472.1 | | 40.3 | 0.071 |
| AD-887473.1 | | 52.3 | 0.055 |
| AD-887474.1 | | 61.7 | 0.079 |
| AD-887475.1 | | 55.7 | 0.020 |
| AD-887476.1 | | 57.8 | 0.026 |
| AD-887477.1 | SCN9A-3 | 45.3 | 0.027 |
| AD-887478.1 | | 26.4 | 0.033 |
| AD-887479.1 | | 69.3 | 0.083 |
| AD-887480.1 | | 24.3 | 0.035 |
| AD-887481.1 | | 28.9 | 0.054 |
| AD-887482.1 | | 32.8 | 0.077 |
| AD-887483.1 | | 31.6 | 0.044 |
| AD-887484.1 | | 39.4 | 0.012 |
| AD-887485.1 | | 38.0 | 0.044 |
| AD-887486.1 | | 46.3 | 0.049 |
| AD-887487.1 | | 50.4 | 0.087 |
| AD-887488.1 | | 47.2 | 0.076 |
| AD-887489.1 | | 54.9 | 0.050 |
| AD-887490.1 | | 65.3 | 0.052 |
| AD-887491.1 | | 74.5 | 0.080 |
| AD-887492.1 | | 63.8 | 0.105 |
| AD-887493.1 | | 89.2 | 0.223 |
| AD-887494.1 | | 43.8 | 0.085 |
| AD-887495.1 | | 71.7 | 0.140 |
| AD-887496.1 | | 85.9 | 0.069 |
| AD-887497.1 | | 72.9 | 0.025 |
| AD-887498.1 | | 52.9 | 0.083 |
| AD-887499.1 | | 78.7 | 0.071 |
| AD-887500.1 | | 70.3 | 0.062 |

TABLE 3-continued

| SCN9A in vitro dual luciferase 10 nM screen with one set of exemplary human SCN9A siRNAs | | | |
|---|---|---|---|
| | | 10 nM | |
| Duplex ID* | Plasmid | % of SCN9A Luciferase signal Remaining | StDev |
| AD-887501.1 | | 60.9 | 0.073 |
| AD-887502.1 | | 59.3 | 0.077 |
| AD-887503.1 | | 55.1 | 0.068 |
| AD-887504.1 | | 63.9 | 0.087 |
| AD-887505.1 | | 63.0 | 0.031 |
| AD-887506.1 | | 62.3 | 0.062 |
| AD-887507.1 | | 70.9 | 0.095 |
| AD-887508.1 | | 56.3 | 0.072 |
| AD-887509.1 | | 78.4 | 0.065 |
| AD-887510.1 | | 50.9 | 0.038 |
| AD-887511.1 | | 75.0 | 0.029 |
| AD-887512.1 | | 81.5 | 0.154 |
| AD-887513.1 | | 65.7 | 0.039 |
| AD-887514.1 | | 53.4 | 0.036 |
| AD-887515.1 | | 55.2 | 0.084 |
| AD-887516.1 | | 69.7 | 0.099 |
| AD-887517.1 | | 68.3 | 0.057 |
| AD-887518.1 | | 91.5 | 0.134 |
| AD-887519.1 | | 101.2 | 0.188 |
| AD-887520.1 | | 72.9 | 0.082 |
| AD-887521.1 | | 75.7 | 0.048 |
| AD-887522.1 | | 70.8 | 0.082 |
| AD-887523.1 | | 89.9 | 0.104 |
| AD-887524.1 | | 54.1 | 0.062 |
| AD-887525.1 | | 61.5 | 0.034 |
| AD-887526.1 | | 58.1 | 0.098 |
| AD-887527.1 | | 66.2 | 0.138 |
| AD-887528.1 | | 72.5 | 0.096 |
| AD-887529.1 | | 80.7 | 0.122 |
| AD-887530.1 | | 73.8 | 0.018 |
| AD-887531.1 | | 81.8 | 0.090 |

(*the number following the decimal point in a duplex name merely refers to a batch production number)

Example 3. In Vitro Screening of SCN9A siRNA

Experimental Methods

Cell Culture and Transfections:

Human neuroblastoma BE(2)-C cells expressing a SC9NA gene were transfected independently by adding 5 μl of Opti-MEM plus 0.1 μl of Lipofectamine RNAiMax per well (Invitrogen, Carlsbad CA cat #13778-150) to 5.1 μl of siRNA duplexes per well into a 384-well plate and are incubated at room temperature for 15 minutes. 40 μl of InVitroGRO CP Medium (BioIVT Cat #Z99029) containing $5\times10^3$ BE(2)-C cells were then added to the siRNA mixture. Cells were incubated for 24 hours prior to RNA purification. Experiments were performed at 0.1 nM, 1 nM, 10 nM, and 50 nM final duplex concentrations and the results are shown in Table 8.

In a second experiment, BE(2)-C cells expressing a SC9NA gene were transfected independently by adding 5 μl of Opti-MEM plus 0.1 μl of Lipofectamine RNAiMax per well (Invitrogen, Carlsbad CA cat #13778-150) to 5.1 μl of siRNA duplexes per well into a 384-well plate and are incubated at room temperature for 15 minutes. 40 μl of InVitroGRO CP Medium (BioIVT Cat #Z99029) containing $5\times10^3$ BE(2)-C cells were then added to the siRNA mixture. Cells were incubated for 24 hours prior to RNA purification. Experiments were performed at 0.1 nM, 1 nM, 10 nM, and 50 nM final duplex concentrations and the results are shown in Table 17.

RNA Isolation:

RNA was isolated using an automated protocol on a BioTek-EL406 platform using DYNABEADs (Invitrogen, Cat #61012). Briefly, 70 μl of Lysis/Binding Buffer and 10 μl of lysis buffer containing 3 μl of magnetic beads were added to the plate with cells. Plates were incubated on an electromagnetic shaker for 10 minutes at room temperature and then magnetic beads were captured and the supernatant was removed. Bead-bound RNA was then washed 2 times with 150 μl Wash Buffer A and once with Wash Buffer B. Beads were then washed with 150 μl Elution Buffer, re-captured and supernatant removed.

cDNA Synthesis:

cDNA was synthesized using ABI High capacity cDNA reverse transcription kit (Applied Biosystems, Foster City, CA, Cat #4368813). 10 μl of a master mix containing 1 μl 10× Buffer, 0.4 μl 25×dNTPs, 1 μl 10× Random primers, 0.5 μl Reverse Transcriptase, 0.5 μl RNase inhibitor and 6.6 μl of H2O per reaction was added to RNA isolated above. Plates were sealed, mixed, and incubated on an electromagnetic shaker for 10 minutes at room temperature, followed by 2 h 37° C.

Real Time PCR:

Two μl of cDNA and 5 μl Lightcycler 480 probe master mix (Roche Cat #04887301001) were added to either 0.5 μl of Human GAPDH TaqMan Probe (4326317E) and 0.5 μl SCN9A Human probe per well in a 384 well plates (Roche cat #04887301001). Real time PCR was done in a LightCycler480 Real Time PCR system (Roche). Each duplex was tested at least two times and data were normalized to cells transfected with a non-targeting control siRNA. To calculate relative fold change, real time data were analyzed using the ΔΔCt method and normalized to assays performed with cells transfected with a non-targeting control siRNA.

Results:

The results of the multi-dose screen in BE(2)-C cells transfected with SCN9A and treated with an exemplary set of SCN9A siRNAs is shown in Table 8 (correspond to siRNAs in Table 4A, 4B, 5A, 5B, 6A, and 6B). The experiment was performed at a 0.1 nM, 1 nM, 10 nM, and 50 nM final duplex concentrations and the data are expressed as percent message remaining relative to non-targeting control.

Of the siRNA duplexes evaluated at 50 nM, 5 achieved ≥80% knockdown of SCN9A, 86 achieved ≥60% knockdown of SCN9A, 266 achieved ≥30% knockdown of SCN9A, 298 achieved ≥20% knockdown of SCN9A, and 314 achieved ≥10% knockdown of SCN9A.

Of the siRNA duplexes evaluated at 10 nM, 2 achieved ≥80% knockdown of SCN9A, 104 achieved ≥60% knockdown of SCN9A, 290 achieved ≥30% knockdown of SCN9A, 316 achieved ≥20% knockdown of SCN9A, and 324 achieved ≥10% knockdown of SCN9A.

Of the siRNA duplexes evaluated at 1 nM, 32 achieved ≥60% knockdown of SCN9A, 203 achieved ≥30% knockdown of SCN9A, 256 achieved ≥20% knockdown of SCN9A, and 296 achieved ≥10% knockdown of SCN9A.

Of the siRNA duplexes evaluated at 0.1 nM, 6 achieved ≥60% knockdown of SCN9A, 111 achieved ≥30% knockdown of SCN9A, 167 achieved ≥20% knockdown of SCN9A, and 213 achieved ≥10% knockdown of SCN9A.

TABLE 8

SCN9A in vitro multidose-dose screen with one set of exemplary human SCN9A siRNA duplexes (*the number following the decimal point in a duplex name merely refers to a batch production number)

| | 50 nM | | 10 nM | | 1 nM | | 0.1 nM | |
|---|---|---|---|---|---|---|---|---|
| Duplex Name* | % message remaining | St. Dev. | % message remaining | St. Dev. | % message remaining | St. Dev. | % message remaining | St. Dev. |
| AD-1010663.1 | 20.4 | 3.1 | 22.0 | 3.4 | 32.2 | 3.3 | 29.7 | 6.2 |
| AD-802123.1 | 25.2 | 4.1 | 31.1 | 2.6 | 27.8 | 2.8 | 34.8 | 5.0 |
| AD-961342.1 | 44.6 | 9.2 | 28.8 | 3.5 | 46.6 | 3.0 | 37.3 | 1.3 |
| AD-961334.1 | 40.1 | 15.1 | 29.6 | 3.2 | 42.0 | 1.2 | 39.5 | 8.9 |
| AD-961179.1 | 26.1 | 1.9 | 28.8 | 3.1 | 38.8 | 1.4 | 39.6 | 2.9 |
| AD-1010661.1 | 22.6 | 2.8 | 24.1 | 5.0 | 39.5 | 4.4 | 39.8 | 5.5 |
| AD-1010662.1 | 27.0 | 4.9 | 21.1 | 3.0 | 44.6 | 7.0 | 40.5 | 7.3 |
| AD-961192.1 | 29.4 | 2.2 | 28.9 | 2.4 | 53.5 | 2.4 | 40.8 | 4.0 |
| AD-961189.1 | 23.7 | 6.1 | 24.3 | 5.6 | 37.6 | 1.4 | 40.9 | 7.4 |
| AD-961188.1 | 19.0 | 0.6 | 22.0 | 4.6 | 34.3 | 5.6 | 41.6 | 1.0 |
| AD-1010665.1 | 48.8 | 5.4 | 36.9 | 1.7 | 69.6 | 4.1 | 42.2 | 3.8 |
| AD-802853.2 | 35.3 | 3.2 | 36.9 | 6.4 | 40.1 | 4.2 | 44.1 | 5.2 |
| AD-802471.2 | 23.7 | 5.7 | 26.1 | 4.9 | 24.5 | 2.6 | 44.5 | 4.4 |
| AD-1010664.1 | 31.0 | 3.8 | 29.9 | 2.3 | 54.2 | 4.4 | 45.0 | 5.2 |
| AD-802552.1 | 27.9 | 5.0 | 34.3 | 2.6 | 37.9 | 5.3 | 45.1 | 5.5 |
| AD-802625.2 | 37.8 | 5.1 | 36.4 | 8.7 | 36.9 | 4.0 | 45.2 | 1.4 |
| AD-802503.1 | 26.6 | 1.1 | 33.7 | 4.0 | 34.4 | 4.0 | 45.3 | 6.4 |
| AD-1010700.1 | 63.7 | 5.0 | 32.4 | 1.4 | 50.5 | 1.4 | 45.4 | 6.4 |
| AD-961207.1 | 19.3 | 1.9 | 21.0 | 4.8 | 43.9 | 10.2 | 45.5 | 10.5 |
| AD-1010671.1 | 23.7 | 4.0 | 26.8 | 4.0 | 52.8 | 7.8 | 45.6 | 2.5 |
| AD-1002101.1 | 33.4 | 7.3 | 39.2 | 3.0 | 50.1 | 6.3 | 45.8 | 4.9 |
| AD-961208.1 | 18.6 | 1.9 | 20.9 | 1.5 | 45.8 | 10.4 | 46.6 | 6.8 |
| AD-1010693.1 | 44.0 | 9.9 | 29.5 | 2.5 | 54.2 | 6.6 | 46.6 | 9.2 |
| AD-802553.1 | 26.7 | 2.6 | 32.2 | 3.2 | 39.1 | 5.6 | 46.9 | 1.3 |
| AD-961190.1 | 24.7 | 1.0 | 28.4 | 5.3 | 49.4 | 5.0 | 47.5 | 4.4 |
| AD-802946.1 | 29.8 | 3.8 | 35.8 | 4.1 | 41.1 | 6.2 | 48.0 | 4.5 |
| AD-961191.1 | 28.3 | 1.1 | 29.0 | 3.0 | 62.2 | 5.6 | 48.9 | 4.8 |
| AD-801647.1 | 31.3 | 4.1 | 31.6 | 3.6 | 45.0 | 6.6 | 48.9 | 6.2 |
| AD-961279.1 | 42.0 | 9.7 | 33.9 | 5.3 | 44.2 | 4.5 | 50.0 | 12.3 |
| AD-1010697.1 | 33.1 | 4.3 | 29.8 | 1.2 | 54.9 | 6.5 | 50.0 | 15.7 |
| AD-799938.1 | 26.4 | 3.5 | 27.5 | 8.3 | 38.6 | 4.0 | 51.0 | 9.2 |
| AD-797636.2 | 34.7 | 6.4 | 25.7 | 2.7 | 53.2 | 9.9 | 52.4 | 8.4 |
| AD-961326.1 | 57.6 | 9.4 | 45.9 | 12.6 | 48.8 | 3.2 | 52.6 | 7.4 |
| AD-802945.2 | 46.1 | 6.1 | 50.0 | 3.4 | 46.1 | 8.6 | 52.7 | 5.3 |
| AD-802206.2 | 37.4 | 2.7 | 43.6 | 2.8 | 40.6 | 9.1 | 53.0 | 2.6 |
| AD-1002409.1 | 40.8 | 11.4 | 43.9 | 2.2 | 48.4 | 7.1 | 53.3 | 6.3 |
| AD-801263.1 | 29.9 | 2.8 | 33.1 | 7.1 | 36.9 | 4.3 | 53.4 | 5.0 |
| AD-961201.1 | 35.3 | 3.4 | 40.8 | 9.3 | 66.4 | 8.6 | 53.9 | 7.0 |
| AD-795371.1 | 22.4 | 3.7 | 21.4 | 1.9 | 31.9 | 1.9 | 54.0 | 3.8 |
| AD-799587.1 | 45.6 | 4.9 | 40.8 | 2.1 | 45.6 | 4.1 | 54.4 | 2.5 |
| AD-802014.1 | 43.0 | 2.7 | 41.3 | 1.7 | 46.1 | 4.2 | 54.8 | 4.1 |
| AD-961182.1 | 32.5 | 3.1 | 33.2 | 5.5 | 39.8 | 3.8 | 54.8 | 26.8 |
| AD-800966.1 | 33.8 | 3.3 | 36.4 | 2.5 | 52.5 | 2.7 | 54.9 | 5.2 |
| AD-795305.1 | 24.5 | 1.5 | 24.8 | 2.0 | 38.9 | 6.0 | 55.0 | 9.3 |
| AD-798584.2 | 45.7 | 5.5 | 33.7 | 3.7 | 55.1 | 5.8 | 55.2 | 7.5 |
| AD-795366.1 | 17.1 | 2.2 | 19.4 | 2.7 | 28.5 | 3.2 | 56.2 | 4.1 |
| AD-1002051.1 | 38.2 | 6.7 | 33.0 | 5.6 | 40.3 | 7.5 | 56.3 | 6.6 |
| AD-961321.1 | 65.9 | 6.7 | 33.8 | 7.4 | 57.5 | 5.1 | 56.7 | 7.8 |
| AD-797565.2 | 23.0 | 1.2 | 20.6 | 4.3 | 43.1 | 4.8 | 56.8 | 3.7 |
| AD-1010698.1 | 57.0 | 8.8 | 30.9 | 2.7 | 49.6 | 2.3 | 56.8 | 12.7 |
| AD-799223.1 | 31.0 | 3.2 | 26.8 | 7.1 | 36.6 | 5.3 | 57.2 | 5.8 |
| AD-801883.2 | 42.9 | 6.3 | 43.7 | 8.6 | 36.9 | 7.0 | 57.2 | 7.5 |
| AD-961155.1 | 58.5 | 4.5 | 50.1 | 5.2 | 54.9 | 9.4 | 57.5 | 8.8 |
| AD-1002100.1 | 45.6 | 11.2 | 48.9 | 6.3 | 58.7 | 6.6 | 57.9 | 11.8 |
| AD-801658.2 | 52.9 | 11.9 | 51.7 | 5.9 | 54.5 | 5.6 | 57.9 | 5.4 |
| AD-800110.1 | 44.3 | 8.0 | 38.6 | 5.0 | 44.2 | 2.1 | 58.2 | 3.5 |
| AD-800819.1 | 32.8 | 1.7 | 32.9 | 6.5 | 48.0 | 7.8 | 58.5 | 4.3 |
| AD-796618.1 | 20.8 | 2.1 | 23.4 | 2.2 | 31.7 | 3.0 | 58.6 | 7.9 |
| AD-797564.2 | 21.6 | 3.1 | 22.7 | 5.7 | 48.6 | 9.8 | 58.9 | 7.8 |
| AD-796825.1 | 13.9 | 1.4 | 18.5 | 2.1 | 26.3 | 2.6 | 59.0 | 6.8 |
| AD-800297.2 | 63.1 | 6.1 | 51.5 | 6.4 | 79.9 | 8.4 | 59.3 | 6.8 |
| AD-801304.1 | 28.5 | 2.6 | 35.0 | 3.7 | 46.5 | 3.5 | 59.5 | 3.2 |
| AD-801708.2 | 48.9 | 5.3 | 46.0 | 7.2 | 57.8 | 5.5 | 59.7 | 9.0 |
| AD-1010673.1 | 27.2 | 4.7 | 28.8 | 4.3 | 52.6 | 17.0 | 59.9 | 8.6 |
| AD-1010699.1 | 72.3 | 3.2 | 33.3 | 4.7 | 53.4 | 2.3 | 59.9 | 10.1 |
| AD-1001246.1 | 40.3 | 4.9 | 40.0 | 1.2 | 51.9 | 7.1 | 60.1 | 10.8 |
| AD-796209.1 | 31.6 | 5.6 | 26.7 | 3.0 | 42.6 | 3.6 | 60.5 | 8.6 |
| AD-801835.1 | 45.7 | 2.8 | 48.9 | 3.6 | 55.6 | 3.5 | 60.6 | 3.2 |
| AD-1010677.1 | 40.4 | 4.5 | 49.1 | 5.8 | 61.3 | 13.3 | 61.1 | 7.1 |
| AD-802141.2 | 51.4 | 7.1 | 50.8 | 3.7 | 54.8 | 3.8 | 61.9 | 1.8 |
| AD-802153.2 | 67.9 | 2.2 | 73.0 | 4.5 | 64.5 | 9.1 | 63.0 | 4.7 |

TABLE 8-continued

SCN9A in vitro multidose-dose screen with one set of exemplary human SCN9A siRNA duplexes (*the number following the decimal point in a duplex name merely refers to a batch production number)

| | 50 nM | | 10 nM | | 1 nM | | 0.1 nM | |
|---|---|---|---|---|---|---|---|---|
| Duplex Name* | % message remaining | St. Dev. | % message remaining | St. Dev. | % message remaining | St. Dev. | % message remaining | St. Dev. |
| AD-1010670.1 | 34.8 | 4.1 | 45.0 | 6.9 | 58.9 | 3.2 | 63.3 | 15.2 |
| AD-800661.1 | 42.7 | 5.7 | 40.6 | 2.9 | 48.7 | 2.1 | 63.3 | 4.1 |
| AD-800058.1 | 50.9 | 6.3 | 42.3 | 2.5 | 46.1 | 1.2 | 63.8 | 3.0 |
| AD-795910.1 | 28.0 | 1.8 | 34.2 | 7.6 | 39.7 | 2.7 | 64.0 | 5.4 |
| AD-961200.1 | 52.8 | 6.6 | 92.3 | 36.4 | 75.1 | 9.5 | 64.1 | 11.1 |
| AD-799939.1 | 34.8 | 3.9 | 36.8 | 0.3 | 39.9 | 3.7 | 64.1 | 3.8 |
| AD-1010660.1 | 42.2 | 1.5 | 48.5 | 9.5 | 70.2 | 10.6 | 64.3 | 10.0 |
| AD-961093.1 | 54.9 | 9.5 | 53.1 | 1.9 | 59.8 | 4.7 | 64.4 | 3.5 |
| AD-1000916.1 | 42.0 | 3.3 | 44.1 | 2.9 | 52.6 | 2.9 | 64.4 | 7.3 |
| AD-801681.2 | 45.4 | 2.6 | 43.0 | 4.6 | 68.1 | 5.1 | 64.5 | 2.9 |
| AD-995116.1 | 27.9 | 6.6 | 25.8 | 2.9 | 48.1 | 13.4 | 64.7 | 3.7 |
| AD-800461.1 | 40.2 | 4.1 | 42.2 | 1.6 | 51.0 | 5.8 | 64.7 | 5.6 |
| AD-996318.1 | 34.1 | 4.7 | 23.8 | 2.0 | 48.5 | 7.4 | 64.8 | 15.1 |
| AD-795634.2 | 23.4 | 6.1 | 23.2 | 7.2 | 46.2 | 15.6 | 65.0 | 9.2 |
| AD-795911.1 | 26.3 | 3.0 | 27.9 | 4.3 | 38.4 | 2.1 | 65.0 | 7.0 |
| AD-797036.1 | 28.3 | 4.7 | 27.8 | 3.2 | 36.2 | 3.2 | 65.1 | 8.0 |
| AD-961137.1 | 44.6 | 5.1 | 45.9 | 1.2 | 63.0 | 7.1 | 65.1 | 5.8 |
| AD-801884.2 | 41.9 | 2.3 | 49.3 | 3.0 | 60.9 | 11.5 | 65.2 | 11.4 |
| AD-801490.2 | 54.0 | 5.7 | 56.2 | 5.9 | 56.4 | 6.6 | 65.3 | 4.7 |
| AD-802145.2 | 47.7 | 1.9 | 54.3 | 4.7 | 45.5 | 8.3 | 65.6 | 10.6 |
| AD-961146.1 | 54.6 | 6.1 | 55.3 | 2.4 | 72.6 | 10.4 | 65.8 | 7.3 |
| AD-795909.1 | 31.2 | 7.9 | 30.8 | 2.9 | 35.2 | 2.7 | 65.9 | 1.8 |
| AD-1010690.1 | 75.9 | 12.7 | 49.3 | 12.4 | 57.5 | 3.7 | 66.0 | 12.8 |
| AD-802071.2 | 64.9 | 7.0 | 58.4 | 6.1 | 70.0 | 2.7 | 66.2 | 5.9 |
| AD-795913.1 | 23.9 | 3.0 | 23.3 | 2.3 | 35.0 | 2.5 | 66.4 | 8.4 |
| AD-800334.1 | 37.2 | 4.7 | 35.3 | 6.1 | 50.8 | 8.2 | 66.4 | 6.1 |
| AD-795739.1 | 29.0 | 5.7 | 24.7 | 2.4 | 42.3 | 6.4 | 66.6 | 2.8 |
| AD-796619.1 | 33.1 | 2.9 | 31.4 | 5.2 | 39.4 | 3.1 | 66.7 | 4.7 |
| AD-800400.1 | 31.8 | 1.9 | 40.7 | 3.5 | 47.8 | 1.4 | 66.9 | 4.9 |
| AD-800414.2 | 53.0 | 5.0 | 45.4 | 1.9 | 66.4 | 4.2 | 67.5 | 3.4 |
| AD-801886.2 | 49.6 | 4.0 | 50.2 | 4.5 | 59.2 | 3.6 | 67.5 | 7.9 |
| AD-961187.1 | 28.8 | 2.4 | 31.2 | 4.7 | 51.7 | 4.6 | 68.4 | 17.7 |
| AD-799594.1 | 47.2 | 2.9 | 40.6 | 4.0 | 47.2 | 3.6 | 69.0 | 2.2 |
| AD-798579.1 | 43.3 | 3.6 | 39.4 | 1.9 | 44.3 | 2.3 | 69.1 | 6.9 |
| AD-802105.2 | 36.1 | 7.1 | 40.4 | 6.5 | 37.8 | 9.7 | 69.5 | 6.2 |
| AD-798588.2 | 40.3 | 3.4 | 31.2 | 2.7 | 66.5 | 8.6 | 69.5 | 4.1 |
| AD-797034.1 | 28.6 | 4.1 | 30.3 | 1.7 | 35.2 | 5.9 | 69.5 | 13.4 |
| AD-961203.1 | 30.2 | 6.1 | 29.8 | 5.7 | 39.5 | 6.4 | 69.6 | 9.5 |
| AD-961259.1 | 58.2 | 9.8 | 40.3 | 6.0 | 53.0 | 5.0 | 69.7 | 18.2 |
| AD-798580.1 | 35.5 | 1.6 | 33.4 | 4.7 | 41.5 | 3.4 | 69.9 | 4.9 |
| AD-1010696.1 | 78.4 | 6.6 | 33.4 | 6.3 | 49.7 | 3.9 | 70.3 | 14.2 |
| AD-802205.2 | 49.5 | 6.6 | 61.7 | 3.0 | 55.9 | 6.6 | 70.4 | 11.7 |
| AD-801724.1 | 36.5 | 4.2 | 37.2 | 2.9 | 51.0 | 5.0 | 70.4 | 5.4 |
| AD-801738.2 | 51.2 | 2.1 | 63.5 | 4.7 | 65.4 | 3.2 | 70.4 | 5.5 |
| AD-801064.1 | 48.5 | 9.8 | 45.5 | 2.6 | 53.6 | 4.4 | 70.5 | 8.3 |
| AD-995486.1 | 36.1 | 3.1 | 27.0 | 4.4 | 52.9 | 6.8 | 70.9 | 7.8 |
| AD-961163.1 | 50.2 | 9.8 | 60.6 | 16.2 | 58.8 | 14.9 | 71.1 | 2.7 |
| AD-961138.1 | 63.7 | 4.3 | 68.4 | 7.2 | 71.9 | 4.3 | 71.1 | 3.8 |
| AD-799231.2 | 40.6 | 3.3 | 44.5 | 8.0 | 60.1 | 7.3 | 71.3 | 7.9 |
| AD-1000046.1 | 40.3 | 4.2 | 41.6 | 3.5 | 62.9 | 5.8 | 71.4 | 8.7 |
| AD-800273.2 | 52.4 | 3.2 | 43.9 | 5.5 | 68.2 | 6.6 | 71.5 | 14.9 |
| AD-800487.1 | 51.9 | 2.7 | 48.7 | 4.4 | 59.8 | 3.7 | 71.6 | 8.4 |
| AD-800069.1 | 56.3 | 4.7 | 46.9 | 2.3 | 52.3 | 3.1 | 71.6 | 3.0 |
| AD-1010694.1 | 81.7 | 6.5 | 50.5 | 9.8 | 67.0 | 4.5 | 71.6 | 19.8 |
| AD-799221.1 | 48.7 | 4.7 | 41.8 | 4.1 | 50.5 | 3.6 | 71.8 | 7.9 |
| AD-961257.1 | 47.5 | 3.9 | 52.3 | 4.9 | 70.0 | 22.0 | 71.8 | 12.1 |
| AD-961014.1 | 58.5 | 4.4 | 40.6 | 3.0 | 78.8 | 5.4 | 72.0 | 3.1 |
| AD-961300.1 | 96.3 | 24.0 | 59.2 | 5.3 | 60.8 | 4.2 | 72.3 | 20.0 |
| AD-800492.2 | 60.4 | 8.3 | 45.2 | 4.5 | 70.2 | 6.9 | 72.4 | 8.3 |
| AD-801957.2 | 53.6 | 4.6 | 68.1 | 8.0 | 59.3 | 7.1 | 72.4 | 5.8 |
| AD-799937.1 | 48.1 | 6.0 | 42.2 | 4.1 | 50.9 | 5.6 | 72.4 | 6.8 |
| AD-800709.2 | 63.6 | 4.5 | 64.5 | 4.7 | 79.1 | 9.5 | 72.5 | 8.7 |
| AD-801832.1 | 42.6 | 4.7 | 50.5 | 6.9 | 55.1 | 2.1 | 72.6 | 5.5 |
| AD-999598.1 | 46.5 | 5.4 | 38.9 | 4.2 | 65.0 | 5.0 | 72.7 | 12.7 |
| AD-800956.1 | 30.7 | 1.7 | 42.5 | 3.5 | 65.7 | 14.9 | 72.8 | 9.8 |
| AD-961225.1 | 36.2 | 0.4 | 36.1 | 3.6 | 60.2 | 8.7 | 73.3 | 10.4 |
| AD-801063.1 | 40.5 | 4.5 | 46.1 | 2.5 | 53.2 | 7.8 | 73.4 | 5.5 |
| AD-801676.2 | 42.2 | 0.7 | 51.9 | 2.3 | 57.8 | 5.1 | 73.5 | 14.7 |
| AD-799942.1 | 38.6 | 5.7 | 41.7 | 4.3 | 47.1 | 3.9 | 73.5 | 5.7 |
| AD-802016.2 | 51.8 | 1.8 | 59.8 | 6.8 | 61.6 | 5.6 | 73.7 | 9.2 |
| AD-1000585.1 | 55.5 | 8.8 | 59.6 | 5.4 | 76.8 | 6.6 | 73.8 | 8.8 |

TABLE 8-continued

SCN9A in vitro multidose-dose screen with one set of exemplary human SCN9A siRNA duplexes (*the number following the decimal point in a duplex name merely refers to a batch production number)

| | 50 nM | | 10 nM | | 1 nM | | 0.1 nM | |
|---|---|---|---|---|---|---|---|---|
| Duplex Name* | % message remaining | St. Dev. | % message remaining | St. Dev. | % message remaining | St. Dev. | % message remaining | St. Dev. |
| AD-1010674.1 | 32.5 | 2.1 | 43.9 | 4.0 | 76.7 | 12.1 | 74.1 | 12.7 |
| AD-801725.1 | 42.2 | 2.6 | 44.5 | 2.8 | 58.5 | 1.2 | 74.2 | 6.3 |
| AD-961350.1 | 62.6 | 6.5 | 31.3 | 2.6 | 57.5 | 2.6 | 74.5 | 10.7 |
| AD-799959.1 | 46.2 | 8.8 | 45.7 | 2.2 | 52.0 | 2.9 | 74.5 | 7.1 |
| AD-800486.1 | 46.9 | 3.0 | 53.4 | 6.3 | 54.7 | 1.5 | 74.6 | 10.4 |
| AD-961245.1 | 52.3 | 10.7 | 53.5 | 10.2 | 54.0 | 2.9 | 74.6 | 13.1 |
| AD-995121.1 | 35.1 | 7.6 | 28.8 | 3.3 | 46.8 | 6.8 | 75.2 | 6.8 |
| AD-995521.1 | 81.9 | 13.8 | 53.3 | 6.1 | 87.0 | 13.5 | 75.3 | 8.9 |
| AD-800849.2 | 57.0 | 4.8 | 47.4 | 6.3 | 80.3 | 3.5 | 75.5 | 11.3 |
| AD-801654.2 | 52.5 | 4.4 | 55.3 | 5.1 | 71.1 | 2.6 | 75.6 | 5.7 |
| AD-802070.2 | 53.7 | 2.3 | 57.9 | 3.4 | 63.2 | 5.1 | 75.8 | 10.7 |
| AD-797699.1 | 43.6 | 5.1 | 37.5 | 4.4 | 54.0 | 4.5 | 76.1 | 15.5 |
| AD-1001409.1 | 54.0 | 3.1 | 58.0 | 4.5 | 65.7 | 6.5 | 76.3 | 1.6 |
| AD-801062.1 | 43.7 | 8.3 | 42.1 | 5.3 | 64.3 | 3.7 | 76.3 | 5.5 |
| AD-801675.2 | 52.4 | 2.7 | 66.7 | 4.3 | 65.1 | 1.9 | 76.4 | 9.3 |
| AD-797964.1 | 53.2 | 10.9 | 56.6 | 3.8 | 54.4 | 4.3 | 76.7 | 5.5 |
| AD-795914.1 | 24.8 | 1.7 | 24.4 | 0.6 | 38.2 | 4.2 | 77.6 | 19.2 |
| AD-796041.1 | 45.7 | 2.5 | 116.1 | 16.4 | 66.8 | 10.4 | 77.8 | 10.4 |
| AD-798667.1 | 47.4 | 6.7 | 55.7 | 20.4 | 55.6 | 5.1 | 78.1 | 12.0 |
| AD-799225.1 | 48.5 | 10.3 | 42.3 | 6.9 | 54.2 | 3.9 | 79.1 | 4.6 |
| AD-961000.1 | 43.8 | 5.3 | 37.5 | 5.3 | 65.4 | 1.0 | 79.2 | 4.8 |
| AD-800490.1 | 50.9 | 6.5 | 45.3 | 5.8 | 53.9 | 4.9 | 79.5 | 8.8 |
| AD-961040.1 | 57.2 | 11.3 | 35.3 | 4.7 | 77.3 | 11.3 | 79.8 | 11.7 |
| AD-795304.1 | 30.0 | 2.9 | 32.1 | 6.3 | 43.3 | 5.5 | 79.9 | 17.9 |
| AD-798577.1 | 53.6 | 3.6 | 45.7 | 6.7 | 51.5 | 3.6 | 79.9 | 8.8 |
| AD-801132.1 | 48.0 | 2.8 | 45.2 | 2.7 | 58.5 | 4.6 | 80.2 | 8.5 |
| AD-961106.1 | 71.2 | 14.7 | 78.0 | 8.6 | 89.8 | 6.5 | 80.2 | 17.7 |
| AD-801747.2 | 49.5 | 5.9 | 49.7 | 4.3 | 75.9 | 6.8 | 80.2 | 4.6 |
| AD-1010667.1 | 71.4 | 16.0 | 71.0 | 15.6 | 73.6 | 3.0 | 80.3 | 21.0 |
| AD-961085.1 | 60.0 | 3.9 | 49.2 | 1.1 | 66.3 | 7.8 | 80.5 | 5.7 |
| AD-961267.1 | 77.9 | 4.6 | 96.8 | 63.6 | 52.3 | 2.5 | 80.6 | 8.3 |
| AD-961221.1 | 57.2 | 12.8 | 66.5 | 7.7 | 79.9 | 23.0 | 80.9 | 20.1 |
| AD-795920.1 | 39.6 | 9.3 | 36.6 | 5.6 | 52.4 | 6.9 | 81.3 | 6.4 |
| AD-1000678.1 | 54.1 | 6.6 | 59.0 | 5.2 | 68.5 | 7.5 | 81.5 | 10.9 |
| AD-796396.1 | 32.3 | 2.9 | 31.3 | 4.6 | 43.5 | 3.1 | 81.8 | 9.8 |
| AD-1010695.1 | 100.2 | 23.6 | 57.9 | 20.2 | 56.9 | 3.8 | 82.2 | 31.8 |
| AD-1010679.1 | 44.4 | 2.9 | 50.8 | 6.2 | 84.4 | 19.0 | 82.6 | 9.3 |
| AD-999715.1 | 60.0 | 9.6 | 58.4 | 10.7 | 71.5 | 5.0 | 83.1 | 6.2 |
| AD-796304.1 | 39.4 | 6.4 | 37.9 | 2.9 | 48.4 | 6.1 | 83.3 | 2.9 |
| AD-795132.1 | 30.6 | 1.6 | 28.3 | 2.9 | 45.1 | 3.5 | 83.3 | 11.6 |
| AD-800060.1 | 54.7 | 4.2 | 50.5 | 5.9 | 56.5 | 3.9 | 83.4 | 3.9 |
| AD-1000106.1 | 75.0 | 7.6 | 59.6 | 11.5 | 80.3 | 9.4 | 83.5 | 7.7 |
| AD-795912.1 | 32.2 | 5.7 | 33.5 | 3.9 | 49.4 | 4.4 | 83.6 | 5.2 |
| AD-961056.1 | 51.2 | 4.5 | 50.5 | 0.9 | 74.5 | 11.3 | 83.8 | 9.1 |
| AD-1010684.1 | 48.0 | 5.6 | 59.3 | 8.8 | 83.1 | 16.0 | 83.9 | 7.8 |
| AD-801601.2 | 58.6 | 2.8 | 57.9 | 1.8 | 75.3 | 11.2 | 84.0 | 6.1 |
| AD-1010666.1 | 64.5 | 9.2 | 72.3 | 15.1 | 78.2 | 5.2 | 84.1 | 21.0 |
| AD-801746.2 | 62.8 | 3.2 | 60.7 | 2.7 | 77.7 | 2.2 | 84.7 | 7.9 |
| AD-796919.1 | 28.1 | 1.1 | 29.9 | 2.8 | 43.1 | 8.4 | 84.8 | 5.2 |
| AD-1000130.1 | 71.1 | 11.5 | 74.5 | 5.6 | 81.1 | 9.7 | 85.2 | 5.8 |
| AD-800387.2 | 53.1 | 4.4 | 49.7 | 4.9 | 75.4 | 3.1 | 85.6 | 15.5 |
| AD-801680.2 | 57.5 | 1.7 | 61.9 | 6.1 | 73.5 | 2.5 | 85.8 | 12.0 |
| AD-1010692.1 | 76.4 | 9.2 | 54.3 | 4.3 | 57.8 | 7.2 | 86.2 | 26.9 |
| AD-801540.2 | 52.6 | 3.2 | 54.5 | 4.7 | 65.3 | 4.2 | 86.6 | 9.7 |
| AD-801251.1 | 58.6 | 4.9 | 50.9 | 2.1 | 61.0 | 6.8 | 86.6 | 12.2 |
| AD-996733.1 | 63.0 | 13.1 | 45.7 | 5.2 | 88.0 | 6.5 | 86.7 | 16.2 |
| AD-961013.1 | 47.9 | 5.1 | 36.5 | 3.8 | 65.6 | 10.8 | 86.8 | 7.5 |
| AD-1000679.1 | 78.4 | 6.9 | 93.8 | 3.9 | 89.7 | 7.8 | 86.9 | 9.2 |
| AD-800389.2 | 63.3 | 4.4 | 56.9 | 6.5 | 81.1 | 11.2 | 87.2 | 9.5 |
| AD-961049.1 | 48.2 | 5.6 | 49.7 | 10.0 | 74.6 | 5.9 | 87.3 | 13.2 |
| AD-961320.1 | 78.9 | 8.5 | 59.3 | 5.6 | 56.5 | 2.4 | 87.5 | 19.6 |
| AD-801491.2 | 59.2 | 3.2 | 71.8 | 8.3 | 75.2 | 13.8 | 87.7 | 2.1 |
| AD-800706.2 | 65.7 | 1.9 | 60.7 | 6.0 | 81.8 | 3.6 | 87.8 | 11.6 |
| AD-801723.2 | 61.3 | 8.1 | 71.3 | 2.1 | 81.4 | 5.5 | 88.0 | 3.2 |
| AD-800606.2 | 54.0 | 3.4 | 50.0 | 10.3 | 89.4 | 4.4 | 88.6 | 13.6 |
| AD-801721.2 | 49.3 | 4.6 | 61.3 | 5.5 | 70.1 | 5.1 | 89.5 | 5.3 |
| AD-1000747.1 | 52.2 | 7.4 | 57.5 | 6.7 | 68.7 | 6.0 | 89.6 | 12.2 |
| AD-797963.1 | 61.3 | 8.6 | 51.2 | 5.4 | 63.7 | 6.8 | 89.7 | 9.3 |
| AD-995055.1 | 44.4 | 3.0 | 37.0 | 3.6 | 66.9 | 11.9 | 89.8 | 6.6 |
| AD-800470.1 | 61.6 | 8.8 | 62.7 | 4.0 | 71.1 | 3.2 | 89.9 | 5.1 |
| AD-961226.1 | 47.0 | 10.8 | 34.8 | 4.4 | 65.4 | 15.8 | 90.0 | 14.2 |

TABLE 8-continued

SCN9A in vitro multidose-dose screen with one set of exemplary human SCN9A siRNA duplexes (*the number following the decimal point in a duplex name merely refers to a batch production number)

| | 50 nM | | 10 nM | | 1 nM | | 0.1 nM | |
|---|---|---|---|---|---|---|---|---|
| Duplex Name* | % message remaining | St. Dev. | % message remaining | St. Dev. | % message remaining | St. Dev. | % message remaining | St. Dev. |
| AD-801678.2 | 56.3 | 3.0 | 62.9 | 5.8 | 68.2 | 2.7 | 90.2 | 10.6 |
| AD-801677.2 | 59.8 | 1.9 | 70.7 | 7.4 | 79.4 | 9.1 | 90.3 | 8.1 |
| AD-801035.2 | 63.3 | 3.1 | 64.8 | 5.2 | 84.3 | 7.3 | 90.4 | 8.0 |
| AD-800386.2 | 49.6 | 1.5 | 50.3 | 3.0 | 67.6 | 9.5 | 91.1 | 5.7 |
| AD-798332.1 | 59.2 | 12.3 | 50.5 | 2.3 | 63.2 | 6.8 | 91.1 | 7.1 |
| AD-802106.2 | 78.8 | 2.3 | 93.0 | 9.7 | 84.6 | 13.3 | 91.5 | 7.9 |
| AD-798614.1 | 70.8 | 15.0 | 64.3 | 8.5 | 89.6 | 14.2 | 91.7 | 12.9 |
| AD-798672.1 | 63.7 | 7.8 | 53.8 | 6.3 | 65.7 | 6.2 | 91.8 | 5.5 |
| AD-961196.1 | 48.3 | 5.6 | 74.3 | 44.2 | 77.1 | 9.4 | 91.9 | 11.8 |
| AD-799230.2 | 48.7 | 3.2 | 46.1 | 4.7 | 68.2 | 6.2 | 92.1 | 6.1 |
| AD-961206.1 | 43.2 | 2.7 | 45.8 | 7.5 | 58.2 | 4.8 | 92.1 | 5.2 |
| AD-800667.2 | 64.2 | 3.4 | 59.5 | 4.7 | 88.0 | 17.1 | 92.6 | 9.3 |
| AD-961022.1 | 39.3 | 2.1 | 31.1 | 2.7 | 62.9 | 5.8 | 92.7 | 11.1 |
| AD-796920.1 | 32.8 | 3.1 | 38.5 | 6.0 | 48.3 | 3.4 | 92.8 | 14.5 |
| AD-801888.2 | 57.3 | 4.9 | 64.7 | 1.1 | 78.4 | 15.3 | 92.9 | 3.8 |
| AD-961239.1 | 52.9 | 5.5 | 45.9 | 9.3 | 57.9 | 6.1 | 93.0 | 10.8 |
| AD-800008.2 | 61.9 | 9.1 | 59.8 | 2.5 | 84.5 | 10.6 | 93.0 | 15.5 |
| AD-800494.2 | 64.5 | 3.2 | 64.2 | 6.0 | 69.1 | 8.2 | 93.7 | 2.0 |
| AD-961296.1 | 92.8 | 5.4 | 67.6 | 5.6 | 99.0 | 54.9 | 94.1 | 18.4 |
| AD-796827.1 | 37.3 | 3.3 | 33.9 | 3.8 | 53.6 | 9.2 | 94.2 | 11.7 |
| AD-961270.1 | 91.7 | 10.3 | 81.5 | 22.7 | 65.3 | 8.8 | 94.3 | 17.1 |
| AD-961012.1 | 116.4 | 6.8 | 82.2 | 2.8 | 122.2 | 12.1 | 94.6 | 14.2 |
| AD-800382.2 | 60.6 | 5.2 | 46.6 | 5.8 | 76.2 | 11.6 | 94.7 | 18.1 |
| AD-799683.1 | 56.0 | 4.2 | 52.2 | 2.8 | 58.6 | 6.3 | 95.0 | 9.7 |
| AD-799549.1 | 63.4 | 4.6 | 60.6 | 3.7 | 67.2 | 2.5 | 95.0 | 4.3 |
| AD-801655.2 | 65.3 | 7.5 | 55.8 | 5.0 | 86.9 | 9.4 | 95.1 | 10.5 |
| AD-801679.2 | 60.1 | 4.0 | 69.5 | 1.9 | 73.1 | 5.1 | 95.6 | 15.9 |
| AD-961011.1 | 47.8 | 4.4 | 42.2 | 3.6 | 73.7 | 11.5 | 95.6 | 4.4 |
| AD-961058.1 | 65.7 | 3.6 | 55.0 | 7.5 | 78.8 | 12.6 | 95.7 | 16.0 |
| AD-800968.2 | 61.3 | 3.7 | 58.7 | 3.1 | 76.2 | 7.2 | 96.0 | 16.7 |
| AD-961010.1 | 43.1 | 5.8 | 37.5 | 1.9 | 72.8 | 11.0 | 96.6 | 10.3 |
| AD-1000864.1 | 107.1 | 13.4 | 95.5 | 6.0 | 97.1 | 2.3 | 96.7 | 13.9 |
| AD-796087.1 | 36.1 | 3.3 | 36.1 | 6.2 | 53.6 | 2.7 | 96.7 | 8.6 |
| AD-961251.1 | 110.4 | 13.6 | 67.3 | 15.3 | 80.3 | 15.8 | 96.8 | 7.9 |
| AD-800495.2 | 64.7 | 6.5 | 67.3 | 7.1 | 82.9 | 7.5 | 97.2 | 7.5 |
| AD-799936.1 | 58.4 | 2.6 | 49.1 | 4.7 | 62.2 | 3.6 | 97.3 | 3.7 |
| AD-801539.2 | 53.2 | 1.9 | 63.5 | 3.2 | 72.3 | 6.5 | 97.4 | 10.1 |
| AD-996130.1 | 61.5 | 4.0 | 58.1 | 7.9 | 87.1 | 8.9 | 97.4 | 11.1 |
| AD-1010669.1 | 42.6 | 4.8 | 61.2 | 10.8 | 71.8 | 10.7 | 97.4 | 21.9 |
| AD-1000115.1 | 81.7 | 6.2 | 74.8 | 14.4 | 85.0 | 3.0 | 97.5 | 9.0 |
| AD-796088.1 | 37.4 | 6.2 | 36.8 | 4.3 | 50.2 | 1.8 | 97.7 | 8.5 |
| AD-795841.1 | 54.9 | 4.4 | 39.4 | 5.1 | 61.5 | 4.4 | 97.9 | 12.5 |
| AD-999259.1 | 56.4 | 9.1 | 52.2 | 3.5 | 78.0 | 10.3 | 98.3 | 24.5 |
| AD-999762.1 | 65.0 | 12.5 | 49.0 | 7.1 | 82.6 | 12.1 | 98.4 | 9.3 |
| AD-801653.1 | 54.6 | 4.6 | 58.3 | 7.0 | 75.1 | 4.0 | 98.5 | 5.8 |
| AD-796138.1 | 28.7 | 5.8 | 29.5 | 4.0 | 44.4 | 1.9 | 98.6 | 13.1 |
| AD-1010676.1 | 56.7 | 10.5 | 76.0 | 8.7 | 101.2 | 44.8 | 98.7 | 14.9 |
| AD-801744.2 | 65.2 | 2.8 | 74.7 | 4.6 | 76.3 | 4.7 | 98.8 | 5.9 |
| AD-795774.1 | 38.0 | 5.1 | 30.6 | 5.0 | 55.3 | 10.0 | 99.2 | 8.4 |
| AD-999601.1 | 75.3 | 4.1 | 61.4 | 2.9 | 97.2 | 18.3 | 99.3 | 19.7 |
| AD-961078.1 | 62.3 | 4.2 | 65.4 | 9.3 | 76.8 | 19.5 | 99.4 | 15.9 |
| AD-798984.1 | 75.3 | 6.8 | 67.0 | 2.9 | 82.7 | 7.3 | 99.8 | 12.7 |
| AD-800007.2 | 68.0 | 5.0 | 69.4 | 7.5 | 98.3 | 9.2 | 100.6 | 7.6 |
| AD-801228.2 | 68.9 | 4.0 | 66.9 | 6.9 | 77.7 | 10.6 | 101.0 | 10.6 |
| AD-961109.1 | 101.8 | 15.6 | 98.2 | 19.2 | 97.9 | 13.9 | 101.1 | 14.5 |
| AD-961057.1 | 57.9 | 7.9 | 47.1 | 5.7 | 79.8 | 8.2 | 101.9 | 10.1 |
| AD-801745.2 | 72.4 | 9.2 | 74.1 | 4.5 | 89.2 | 6.6 | 102.0 | 16.4 |
| AD-801489.2 | 72.9 | 6.2 | 69.0 | 5.9 | 84.2 | 5.7 | 102.3 | 6.5 |
| AD-800388.2 | 71.5 | 1.7 | 57.6 | 3.1 | 95.3 | 3.6 | 102.9 | 9.8 |
| AD-796936.1 | 37.1 | 3.5 | 40.9 | 3.8 | 61.3 | 1.8 | 103.7 | 9.8 |
| AD-796318.1 | 44.4 | 7.3 | 47.3 | 3.3 | 66.9 | 8.6 | 103.9 | 6.5 |
| AD-801397.2 | 64.6 | 4.3 | 69.9 | 11.1 | 80.7 | 2.8 | 104.1 | 7.6 |
| AD-961004.1 | 89.4 | 11.4 | 88.5 | 8.5 | 107.5 | 19.2 | 104.7 | 9.5 |
| AD-961202.1 | 53.4 | 5.1 | 49.3 | 15.0 | 71.3 | 8.2 | 104.8 | 10.1 |
| AD-995873.1 | 40.1 | 1.2 | 34.6 | 6.0 | 78.2 | 9.9 | 105.0 | 18.1 |
| AD-801022.2 | 62.7 | 2.8 | 63.0 | 5.3 | 88.2 | 7.8 | 105.3 | 11.8 |
| AD-800496.2 | 68.4 | 1.8 | 63.4 | 5.7 | 90.2 | 7.0 | 105.5 | 11.7 |
| AD-1010668.1 | 54.7 | 6.4 | 50.1 | 10.3 | 61.7 | 4.4 | 105.6 | 30.8 |
| AD-801399.2 | 61.6 | 4.5 | 68.1 | 6.4 | 78.8 | 4.5 | 106.3 | 6.9 |
| AD-961227.1 | 70.7 | 13.2 | 62.4 | 18.3 | 69.4 | 13.2 | 106.6 | 24.6 |
| AD-961285.1 | 84.7 | 4.3 | 58.6 | 4.4 | 57.0 | 4.0 | 106.8 | 12.3 |

TABLE 8-continued

SCN9A in vitro multidose-dose screen with one set of exemplary human SCN9A siRNA duplexes (*the number following the decimal point in a duplex name merely refers to a batch production number)

| | 50 nM | | 10 nM | | 1 nM | | 0.1 nM | |
|---|---|---|---|---|---|---|---|---|
| Duplex Name* | % message remaining | St. Dev. | % message remaining | St. Dev. | % message remaining | St. Dev. | % message remaining | St. Dev. |
| AD-799010.2 | 72.4 | 3.2 | 63.8 | 6.6 | 88.7 | 8.9 | 107.6 | 22.6 |
| AD-961243.1 | 64.6 | 17.0 | 66.4 | 9.0 | 60.3 | 13.3 | 107.8 | 12.8 |
| AD-800974.2 | 62.8 | 3.6 | 69.2 | 4.8 | 80.5 | 5.3 | 108.5 | 6.8 |
| AD-800850.2 | 68.8 | 7.6 | 64.0 | 1.7 | 83.0 | 5.1 | 110.0 | 9.7 |
| AD-961066.1 | 64.2 | 6.4 | 68.6 | 9.0 | 94.8 | 8.0 | 110.6 | 11.9 |
| AD-961220.1 | 91.6 | 11.9 | 97.9 | 17.5 | 106.8 | 19.0 | 111.3 | 15.8 |
| AD-1010683.1 | 91.9 | 9.3 | 84.9 | 13.1 | 91.8 | 11.9 | 111.6 | 15.8 |
| AD-961009.1 | 86.0 | 8.0 | 64.8 | 11.9 | 94.8 | 15.3 | 111.9 | 10.9 |
| AD-961269.1 | 91.7 | 11.5 | 69.7 | 4.0 | 74.8 | 15.5 | 112.3 | 11.0 |
| AD-961271.1 | 54.8 | 11.6 | 66.8 | 8.6 | 63.9 | 4.8 | 112.5 | 10.4 |
| AD-961042.1 | 131.0 | 17.7 | 104.1 | 14.8 | 132.1 | 19.7 | 113.1 | 16.1 |
| AD-961233.1 | 86.8 | 2.7 | 92.3 | 11.2 | 115.2 | 12.0 | 113.5 | 24.6 |
| AD-1010691.1 | 83.2 | 13.4 | 70.3 | 12.5 | 70.5 | 20.0 | 114.3 | 9.2 |
| AD-1010680.1 | 75.5 | 14.3 | 62.1 | 20.6 | 69.2 | 3.6 | 115.3 | 9.3 |
| AD-997386.1 | 75.4 | 11.9 | 54.6 | 2.2 | 102.7 | 5.3 | 115.7 | 10.0 |
| AD-801140.2 | 81.4 | 2.3 | 73.8 | 7.3 | 110.3 | 8.9 | 115.8 | 18.3 |
| AD-996618.1 | 49.0 | 6.8 | 40.5 | 1.0 | 83.2 | 17.7 | 115.9 | 14.5 |
| AD-1000451.1 | 102.3 | 7.4 | 100.7 | 10.4 | 117.9 | 11.6 | 116.1 | 6.2 |
| AD-961024.1 | 102.3 | 1.9 | 90.5 | 8.4 | 129.4 | 9.6 | 116.2 | 7.7 |
| AD-1010688.1 | 81.2 | 10.5 | 68.2 | 16.2 | 76.2 | 10.5 | 116.4 | 5.1 |
| AD-999721.1 | 88.2 | 14.5 | 74.3 | 8.8 | 105.7 | 7.6 | 117.0 | 15.7 |
| AD-999986.1 | 92.1 | 7.1 | 68.3 | 4.2 | 103.6 | 25.5 | 117.7 | 4.4 |
| AD-961252.1 | 76.5 | 5.7 | 71.6 | 8.5 | 93.7 | 5.0 | 118.3 | 8.2 |
| AD-1000133.1 | 108.6 | 9.9 | 104.8 | 4.5 | 103.4 | 14.8 | 118.4 | 22.2 |
| AD-1010672.1 | 47.9 | 7.7 | 34.5 | 10.1 | 67.6 | 14.0 | 119.1 | 14.0 |
| AD-961039.1 | 63.3 | 8.9 | 50.4 | 6.3 | 92.7 | 18.6 | 119.5 | 8.3 |
| AD-800384.2 | 109.7 | 11.6 | 107.5 | 11.0 | 157.3 | 12.1 | 119.8 | 16.6 |
| AD-998897.1 | 95.0 | 7.2 | 80.0 | 8.1 | 113.6 | 10.8 | 119.8 | 13.0 |
| AD-996319.1 | 50.5 | 3.3 | 41.7 | 4.8 | 93.7 | 5.9 | 119.9 | 18.3 |
| AD-996635.1 | 69.5 | 5.3 | 60.3 | 5.6 | 107.1 | 1.9 | 120.2 | 14.4 |
| AD-1010678.1 | 88.1 | 12.5 | 85.5 | 10.6 | 89.0 | 17.2 | 121.1 | 15.0 |
| AD-1010685.1 | 111.6 | 15.7 | 108.7 | 12.2 | 78.0 | 7.2 | 122.2 | 7.9 |
| AD-961044.1 | 97.5 | 9.6 | 88.4 | 12.2 | 134.5 | 10.9 | 122.7 | 22.2 |
| AD-1010686.1 | 78.7 | 6.5 | 76.7 | 7.0 | 86.1 | 26.9 | 123.1 | 19.5 |
| AD-1010687.1 | 117.9 | 15.8 | 115.2 | 30.5 | 107.5 | 26.3 | 124.7 | 19.7 |
| AD-994670.1 | 129.5 | 59.3 | 134.9 | 46.8 | 118.4 | 32.5 | 124.8 | 42.9 |
| AD-996052.1 | 91.5 | 4.9 | 72.6 | 13.5 | 121.3 | 21.0 | 125.5 | 29.0 |
| AD-961244.1 | 76.7 | 11.0 | 77.3 | 12.3 | 86.9 | 17.0 | 125.7 | 11.9 |
| AD-1010689.1 | 97.6 | 12.4 | 70.6 | 13.0 | 72.1 | 13.8 | 125.7 | 12.1 |
| AD-998894.1 | 99.2 | 7.1 | 92.6 | 8.1 | 127.6 | 21.1 | 126.2 | 23.1 |
| AD-995824.1 | 79.3 | 6.1 | 79.4 | 5.6 | 132.8 | 21.0 | 127.8 | 17.2 |
| AD-998346.1 | 63.5 | 10.6 | 50.5 | 11.1 | 83.0 | 29.0 | 127.9 | 17.0 |
| AD-995660.1 | 136.0 | 20.1 | 113.3 | 16.3 | 138.8 | 21.7 | 128.3 | 27.5 |
| AD-961204.1 | 131.2 | 6.3 | 120.0 | 23.3 | 93.0 | 6.9 | 128.4 | 16.1 |
| AD-998261.1 | 92.0 | 5.8 | 69.2 | 3.7 | 120.4 | 14.9 | 128.8 | 10.2 |
| AD-800975.2 | 68.4 | 14.1 | 70.0 | 14.9 | 93.4 | 23.3 | 128.9 | 30.2 |
| AD-794914.1 | 54.4 | 20.5 | 45.0 | 8.5 | 85.8 | 5.5 | 129.1 | 22.5 |
| AD-1010682.1 | 74.2 | 13.6 | 73.0 | 10.6 | 77.2 | 11.2 | 129.5 | 7.4 |
| AD-961246.1 | 74.2 | 5.9 | 67.8 | 8.9 | 104.0 | 16.8 | 130.0 | 10.2 |
| AD-961037.1 | 73.0 | 6.1 | 55.0 | 6.2 | 97.9 | 11.1 | 130.1 | 15.6 |
| AD-961043.1 | 113.8 | 12.2 | 101.4 | 8.0 | 136.2 | 19.6 | 131.8 | 6.0 |
| AD-798031.1 | 80.4 | 12.9 | 69.9 | 8.2 | 86.4 | 19.4 | 132.3 | 18.6 |
| AD-961232.1 | 106.8 | 22.1 | 102.7 | 18.1 | 127.4 | 26.3 | 132.5 | 16.0 |
| AD-996036.1 | 110.9 | 9.5 | 102.8 | 7.5 | 123.2 | 6.6 | 132.5 | 11.3 |
| AD-995573.1 | 144.5 | 17.9 | 109.1 | 8.6 | 139.9 | 28.2 | 132.8 | 12.3 |
| AD-995587.1 | 141.8 | 15.3 | 112.6 | 18.3 | 141.1 | 16.7 | 133.9 | 11.4 |
| AD-961295.1 | 100.5 | 8.5 | 78.2 | 5.3 | 76.0 | 6.5 | 135.3 | 15.9 |
| AD-999596.1 | 102.6 | 5.7 | 93.6 | 13.8 | 131.0 | 1.9 | 136.1 | 27.0 |
| AD-996619.1 | 94.9 | 5.1 | 96.5 | 13.6 | 118.2 | 17.2 | 136.6 | 10.8 |
| AD-795826.1 | 70.1 | 11.1 | 56.1 | 13.8 | 100.3 | 7.9 | 136.7 | 18.9 |
| AD-998015.1 | 82.1 | 2.8 | 63.8 | 3.4 | 107.7 | 11.0 | 137.3 | 5.5 |
| AD-1010675.1 | 90.0 | 16.1 | 76.8 | 13.1 | 99.9 | 24.3 | 137.7 | 24.0 |
| AD-1010681.1 | 102.6 | 13.3 | 91.2 | 26.3 | 119.3 | 18.8 | 138.2 | 22.6 |
| AD-995823.1 | 77.4 | 5.2 | 69.6 | 8.2 | 127.3 | 13.1 | 138.3 | 14.2 |
| AD-999215.1 | 97.0 | 18.5 | 87.0 | 4.4 | 113.7 | 16.5 | 139.4 | 19.5 |
| AD-801020.2 | 78.5 | 6.5 | 66.2 | 5.4 | 101.1 | 4.1 | 139.7 | 11.6 |
| AD-999348.1 | 87.0 | 12.7 | 80.6 | 3.6 | 111.4 | 12.2 | 141.1 | 13.3 |
| AD-996533.1 | 110.0 | 6.7 | 110.4 | 11.6 | 148.8 | 15.8 | 146.0 | 22.6 |
| AD-961036.1 | 129.0 | 17.9 | 106.4 | 13.8 | 135.2 | 13.4 | 149.0 | 12.0 |

TABLE 8-continued

SCN9A in vitro multidose-dose screen with one set of exemplary human SCN9A siRNA duplexes (*the number following the decimal point in a duplex name merely refers to a batch production number)

| | 50 nM | | 10 nM | | 1 nM | | 0.1 nM | |
|---|---|---|---|---|---|---|---|---|
| Duplex Name* | % message remaining | St. Dev. | % message remaining | St. Dev. | % message remaining | St. Dev. | % message remaining | St. Dev. |
| AD-961231.1 | 131.4 | 20.6 | 127.4 | 10.6 | 126.4 | 31.6 | 155.5 | 24.9 |
| AD-997715.1 | 117.7 | 16.6 | 110.1 | 14.6 | 129.0 | 20.5 | 157.2 | 35.0 |
| AD-801309.2 | 59.4 | 6.8 | 63.1 | 7.3 | 83.8 | 4.8 | 158.4 | 66.9 |

The results of the multi-dose screen in BE(2)-C cells expressing a SCN9A gene and treated with an exemplary set of SCN9A siRNAs is shown in Table 17 (correspond to siRNAs in Table 13A). The experiment was performed at a 0.1 nM, 1 nM, 10 nM, and 50 nM final duplex concentrations and the data are expressed as percent message remaining relative to non-targeting control.

Of the siRNA duplexes evaluated at 50 nM in Table 17, 5 achieved ≥90% knockdown of SCN9A, 52 achieved ≥80% knockdown of SCN9A, 180 achieved ≥60% knockdown of SCN9A, 254 achieved ≥30% knockdown of SCN9A, 261 achieved ≥20% knockdown of SCN9A, and 264 achieved ≥10% knockdown of SCN9A.

Of the siRNA duplexes evaluated at 10 nM in Table 17, 3 achieved ≥90% knockdown of SCN9A, 59 achieved ≥80% knockdown of SCN9A, 174 achieved ≥60% knockdown of SCN9A, 233 achieved ≥30% knockdown of SCN9A, 249 achieved ≥20% knockdown of SCN9A, and 255 achieved ≥10% knockdown of SCN9A.

Of the siRNA duplexes evaluated at 1 nM in Table 17, 2 achieved ≥90% knockdown of SCN9A, 15 achieved ≥80% knockdown of SCN9A, 109 achieved ≥60% knockdown of SCN9A, 228 achieved ≥30% knockdown of SCN9A, 247 achieved ≥20% knockdown of SCN9A, and 258 achieved ≥10% knockdown of SCN9A.

Of the siRNA duplexes evaluated at 0.1 nM in Table 17, 9 achieved ≥70% knockdown of SCN9A, 30 achieved ≥60% knockdown of SCN9A, 77 achieved ≥50% knockdown of SCN9A, 178 achieved ≥30% knockdown of SCN9A, 203 achieved ≥20% knockdown of SCN9A, and 225 achieved ≥10% knockdown of SCN9A.

TABLE 17

SCN9A in vitro multidose-dose screen with one set of exemplary human SCN9A siRNA duplexes (*the number following the decimal point in a duplex name merely refers to a batch production number)

| | | | 50 nM | | 10 nM | | 1 nM | | 0.1 nM | |
|---|---|---|---|---|---|---|---|---|---|---|
| Duplex | SC9NA | Mis-match | % message remaining | St. Dev. | % message remaining | St. Dev. | % message remaining | St. Dev. | % message remaining | St. Dev. |
| AD-1251302.1 | HsSCN9A_ORF1rp | 3 | 88.2 | 15.4 | 75.7 | 19.8 | 81.6 | 6.1 | 70.8 | 2.7 |
| AD-1251303.1 | HsSCN9A_ORF1rp | 2 | 73.2 | 8.7 | 84.2 | 27.4 | 61.9 | 8.6 | 68.2 | 3.6 |
| AD-1251304.1 | HsSCN9A_ORF1rp | 1 | 25.8 | 4.0 | 53.2 | 23.0 | 44.2 | 5.1 | 43.9 | 1.7 |
| AD-1251305.1 | HsSCN9A_ORF1rp | 1 | 25.6 | 4.7 | 18.8 | 3.3 | 38.3 | 6.9 | 49.1 | 3.4 |
| AD-1251306.1 | HsSCN9A_ORF1rp | 1 | 27.7 | 5.2 | 20.7 | 2.1 | 40.2 | 9.0 | 55.6 | 5.5 |
| AD-1251307.1 | HsSCN9A_ORF1rp | 1 | 40.5 | 2.1 | 64.0 | 22.8 | 56.1 | 4.4 | 68.3 | 4.1 |
| AD-1251315.1 | HsSCN9A_ORF1rp | 1 | 26.6 | 1.3 | 24.7 | 1.5 | 44.7 | 4.8 | 46.9 | 2.6 |
| AD-1251310.1 | HsSCN9A_ORF1rp | 1 | 32.0 | 1.1 | 28.3 | 2.0 | 48.9 | 5.1 | 59.8 | 5.1 |
| AD-961179.3 | HsSCN9A_ORF1rp | 1 | 33.9 | 2.9 | 29.3 | 3.2 | 42.5 | 4.8 | 49.9 | 3.7 |
| AD-1251308.1 | HsSCN9A_ORF1rp | 1 | 40.3 | 3.7 | 29.4 | 2.8 | 49.1 | 6.4 | 58.1 | 3.5 |
| AD-1251314.1 | HsSCN9A_ORF1rp | 1 | 41.7 | 3.0 | 34.1 | 2.9 | 58.0 | 8.3 | 58.8 | 3.4 |
| AD-1251309.2 | HsSCN9A_ORF1rp | 1 | 48.4 | 3.9 | 34.4 | 1.1 | 66.1 | 10.1 | 60.3 | 4.9 |
| AD-1251316.1 | HsSCN9A_ORF1rp | 1 | 43.4 | 2.5 | 37.1 | 6.7 | 49.8 | 1.7 | 72.8 | 16.2 |
| AD-1251317.1 | HsSCN9A_ORF1rp | 1 | 27.2 | 2.9 | 58.7 | 43.5 | 34.3 | 2.0 | 40.3 | 2.7 |
| AD-1251311.1 | HsSCN9A_ORF1rp | 1 | 45.9 | 14.8 | 58.9 | 37.2 | 59.2 | 4.8 | 69.3 | 24.8 |
| AD-1251309.1 | HsSCN9A_ORF1rp | 1 | 53.5 | 3.2 | 80.0 | 46.2 | 57.9 | 4.1 | 64.7 | 5.8 |
| AD-1251318.1 | HsSCN9A_ORF1rp | 1 | 23.3 | 1.3 | 18.0 | 2.7 | 30.2 | 5.3 | 37.7 | 7.8 |
| AD-1251319.1 | HsSCN9A_ORF1rp | 1 | 25.4 | 0.9 | 21.3 | 1.9 | 48.0 | 13.8 | 46.8 | 1.6 |
| AD-1251313.1 | HsSCN9A_ORF1rp | 1 | 36.3 | 1.6 | 30.8 | 7.3 | 53.0 | 4.0 | 65.6 | 4.2 |
| AD-1251312.1 | HsSCN9A_ORF1rp | 1 | 54.4 | 6.9 | 38.8 | 2.4 | 66.9 | 5.4 | 69.3 | 3.5 |
| AD-1251320.1 | HsSCN9A_ORF1rp | 1 | 26.5 | 2.0 | 43.2 | 29.5 | 39.8 | 5.2 | 47.7 | 5.3 |
| AD-1251321.1 | HsSCN9A_ORF1rp | 0 | 19.3 | 3.3 | 15.3 | 3.5 | 38.1 | 12.7 | 36.2 | 2.4 |
| AD-1251323.1 | HsSCN9A_ORF1rp | 0 | 17.3 | 4.1 | 18.9 | 9.8 | 27.2 | 4.7 | 35.9 | 5.5 |
| AD-1251322.1 | HsSCN9A_ORF1rp | 1 | 16.3 | 2.4 | 22.5 | 10.0 | 27.5 | 1.2 | 40.8 | 5.4 |
| AD-1251325.1 | HsSCN9A_ORF1rp | 1 | 19.6 | 2.8 | 30.6 | 15.0 | 29.2 | 5.3 | 35.4 | 1.6 |
| AD-1251324.1 | HsSCN9A_ORF1rp | 1 | 22.0 | 9.0 | 33.4 | 14.4 | 27.5 | 6.9 | 33.2 | 2.7 |
| AD-1251249.1 | HsSCN9A_ORF1rp | 1 | 25.0 | 2.2 | 15.0 | 1.3 | 29.6 | 6.1 | 36.6 | 5.4 |
| AD-1251254.1 | HsSCN9A_ORF1rp | 1 | 19.3 | 1.3 | 17.6 | 2.9 | 30.4 | 4.1 | 43.8 | 20.0 |
| AD-1251248.1 | HsSCN9A_ORF1rp | 1 | 29.8 | 5.2 | 17.8 | 2.4 | 35.8 | 4.6 | 47.0 | 6.4 |
| AD-1251284.1 | HsSCN9A_ORF1rp | 1 | 21.8 | 1.9 | 19.0 | 2.4 | 30.1 | 3.3 | 32.2 | 1.8 |
| AD-1251253.1 | HsSCN9A_ORF1rp | 1 | 28.6 | 2.0 | 22.0 | 3.0 | 48.2 | 5.9 | 102.4 | 47.0 |
| AD-1251286.1 | HsSCN9A_ORF1rp | 1 | 25.4 | 4.1 | 22.6 | 3.5 | 36.5 | 5.9 | 37.3 | 3.7 |
| AD-1251282.1 | HsSCN9A_ORF1rp | 1 | 30.9 | 8.8 | 22.8 | 9.3 | 36.9 | 5.5 | 50.8 | 3.4 |
| AD-1010661.3 | HsSCN9A_ORF1rp | 1 | 34.2 | 4.6 | 23.1 | 5.5 | 48.8 | 11.5 | 56.1 | 6.3 |

TABLE 17-continued

SCN9A in vitro multidose-dose screen with one set of exemplary human SCN9A siRNA duplexes (*the number following the decimal point in a duplex name merely refers to a batch production number)

| | | | 50 nM | | 10 nM | | 1 nM | | 0.1 nM | |
|---|---|---|---|---|---|---|---|---|---|---|
| Duplex | SC9NA | Mis-match | % message remaining | St. Dev. | % message remaining | St. Dev. | % message remaining | St. Dev. | % message remaining | St. Dev. |
| AD-795305.3 | HsSCN9A_ORF1rp | 1 | 23.6 | 3.8 | 23.4 | 16.3 | 47.7 | | 36.0 | 2.0 |
| AD-1251250.1 | HsSCN9A_ORF1rp | 1 | 22.9 | 1.8 | 24.6 | 12.5 | 30.6 | 3.7 | 43.6 | 4.7 |
| AD-1251283.1 | HsSCN9A_ORF1rp | 1 | 28.9 | 6.0 | 26.8 | 9.0 | 36.5 | 7.8 | 45.0 | 5.7 |
| AD-1251281.1 | HsSCN9A_ORF1rp | 1 | 33.7 | 11.0 | 26.8 | 5.7 | 54.1 | 5.9 | 61.1 | 2.6 |
| AD-1251255.1 | HsSCN9A_ORF1rp | 1 | 30.5 | 1.9 | 26.9 | 10.7 | 49.1 | 8.5 | 63.8 | 5.7 |
| AD-1251289.1 | HsSCN9A_ORF1rp | 1 | 26.4 | 1.6 | 35.1 | 5.9 | 49.0 | 4.2 | 68.1 | 9.7 |
| AD-1251252.1 | HsSCN9A_ORF1rp | 1 | 28.1 | 1.9 | 44.5 | 31.9 | 44.9 | 4.2 | 58.8 | 6.1 |
| AD-1251285.1 | HsSCN9A_ORF1rp | 1 | 34.3 | 5.6 | 47.3 | 33.3 | 50.0 | 5.3 | 60.3 | 8.1 |
| AD-1251291.1 | HsSCN9A_ORF1rp | 1 | 39.7 | 7.7 | 48.5 | 18.9 | 64.0 | 15.2 | 64.5 | 3.5 |
| AD-1251290.1 | HsSCN9A_ORF1rp | 1 | 23.7 | 2.0 | 66.4 | 27.7 | 36.9 | 2.3 | 42.2 | 3.7 |
| AD-1251251.1 | HsSCN9A_ORF1rp | 1 | 17.9 | 0.8 | 13.9 | 1.9 | 27.8 | 4.8 | 35.4 | 3.9 |
| AD-1251287.1 | HsSCN9A_ORF1rp | 1 | 27.9 | 7.8 | 25.9 | 0.7 | 49.1 | 10.2 | 55.2 | 7.4 |
| AD-1251288.1 | HsSCN9A_ORF1rp | 1 | 21.3 | 4.1 | 29.0 | 7.5 | 51.3 | 18.3 | 41.2 | 2.0 |
| AD-1251326.1 | HsSCN9A_ORF1rp | 1 | 32.0 | 5.4 | 24.4 | 0.2 | 52.9 | 3.2 | 63.0 | 3.0 |
| AD-1251327.1 | HsSCN9A_ORF1rp | 1 | 67.9 | 7.7 | 74.9 | 27.8 | 69.2 | 9.1 | 69.9 | 2.9 |
| AD-1251328.1 | HsSCN9A_ORF1rp | 1 | 19.3 | 2.3 | 25.3 | 4.0 | 27.3 | 6.1 | 66.1 | 5.8 |
| AD-1251329.1 | HsSCN9A_ORF1rp | 0 | 34.9 | 1.9 | 101.9 | 3.9 | 55.1 | 4.7 | 91.4 | 8.7 |
| AD-1251330.1 | HsSCN9A_ORF1rp | 1 | 54.9 | 5.1 | 48.1 | 3.6 | 55.2 | 9.0 | 77.1 | 10.3 |
| AD-795366.3 | HsSCN9A_ORF1rp | 1 | 18.6 | 5.7 | 15.7 | 2.4 | 26.1 | 8.5 | 42.8 | 7.0 |
| AD-1251331.1 | HsSCN9A_ORF1rp | 1 | 17.6 | 2.0 | 20.9 | 1.5 | 30.8 | 6.1 | 56.5 | 4.6 |
| AD-1251334.1 | HsSCN9A_ORF1rp | 1 | 20.1 | 5.8 | 26.4 | 2.8 | 24.2 | 2.8 | 37.1 | 6.4 |
| AD-1251333.1 | HsSCN9A_ORF1rp | 1 | 27.0 | 1.6 | 28.8 | 4.2 | 40.8 | 4.7 | 59.1 | 6.6 |
| AD-1251338.1 | HsSCN9A_ORF1rp | 1 | 28.5 | 2.0 | 31.6 | 6.3 | 47.9 | 0.7 | 92.7 | 10.2 |
| AD-1251337.1 | HsSCN9A_ORF1rp | 1 | 39.3 | 2.5 | 41.6 | 5.2 | 65.7 | 13.5 | 98.8 | 6.2 |
| AD-1251336.1 | HsSCN9A_ORF1rp | 1 | 45.9 | 3.6 | 54.4 | 6.2 | 72.8 | 7.3 | 106.0 | 11.0 |
| AD-1251335.1 | HsSCN9A_ORF1rp | 1 | 52.5 | 6.1 | 71.4 | 5.5 | 66.2 | 6.9 | 101.9 | 22.0 |
| AD-1251339.1 | HsSCN9A_ORF1rp | 1 | 25.4 | 1.0 | 28.3 | 2.1 | 51.9 | 2.0 | 78.1 | 7.9 |
| AD-1251340.1 | HsSCN9A_ORF1rp | 1 | 34.1 | 3.9 | 29.5 | 5.2 | 45.8 | 1.2 | 65.6 | 8.5 |
| AD-1251341.1 | HsSCN9A_ORF1rp | 1 | 51.9 | 2.9 | 48.3 | 5.0 | 51.3 | 3.3 | 60.1 | 7.4 |
| AD-1251342.1 | HsSCN9A_ORF1rp | 1 | 18.3 | 4.3 | 20.8 | 1.3 | 20.2 | 2.5 | 27.9 | 2.1 |
| AD-1251347.1 | HsSCN9A_ORF1rp | 1 | 25.4 | 4.3 | 15.9 | 5.6 | 34.8 | 4.4 | 55.2 | 6.2 |
| AD-795371.3 | HsSCN9A_ORF1rp | 1 | 17.3 | 3.2 | 19.0 | 4.2 | 24.1 | 8.2 | 43.4 | 5.8 |
| AD-1010663.3 | HsSCN9A_ORF1rp | 1 | 28.3 | 2.4 | 20.4 | 1.6 | 32.5 | 3.5 | 45.2 | 5.2 |
| AD-1251301.1 | HsSCN9A_ORF1rp | 1 | 26.4 | 1.3 | 20.4 | 1.5 | 39.6 | 3.0 | 47.9 | 5.8 |
| AD-1251348.1 | HsSCN9A_ORF1rp | 2 | 17.5 | 8.4 | 22.8 | 2.1 | 29.8 | 6.8 | 41.0 | 5.3 |
| AD-1251343.1 | HsSCN9A_ORF1rp | 1 | 23.1 | 1.6 | 23.3 | 4.6 | 41.3 | 7.1 | 63.7 | 11.5 |
| AD-1251346.1 | HsSCN9A_ORF1rp | 1 | 29.4 | 3.4 | 26.2 | 4.3 | 46.1 | 2.1 | 68.6 | 14.2 |
| AD-1251299.1 | HsSCN9A_ORF1rp | 1 | 32.4 | 7.9 | 29.5 | 14.3 | 48.7 | 3.5 | 58.7 | 3.8 |
| AD-1251345.1 | HsSCN9A_ORF1rp | 2 | 30.4 | 2.1 | 29.7 | 3.6 | 47.7 | 6.3 | 78.9 | 7.2 |
| AD-1251349.1 | HsSCN9A_ORF1rp | 1 | 23.8 | 4.4 | 31.2 | 6.1 | 33.6 | 11.0 | 55.6 | 10.1 |
| AD-1251292.1 | HsSCN9A_ORF1rp | 1 | 27.0 | 3.7 | 31.8 | 12.7 | 42.1 | 6.7 | 128.8 | 66.1 |
| AD-1251293.1 | HsSCN9A_ORF1rp | 1 | 32.4 | 4.6 | 32.5 | 13.1 | 43.9 | 4.9 | 58.5 | 4.1 |
| AD-1251294.1 | HsSCN9A_ORF1rp | 2 | 44.6 | 3.5 | 33.3 | 3.3 | 54.8 | 5.2 | 65.1 | 0.8 |
| AD-1251344.1 | HsSCN9A_ORF1rp | 1 | 30.0 | 2.9 | 33.5 | 2.0 | 47.0 | 4.6 | 81.8 | 7.0 |
| AD-1251300.1 | HsSCN9A_ORF1rp | 1 | 32.2 | 4.4 | 39.5 | 21.6 | 42.6 | 3.6 | 58.2 | 4.4 |
| AD-1251295.1 | HsSCN9A_ORF1rp | 1 | 31.6 | 5.8 | 43.2 | 12.4 | 64.8 | 4.1 | 62.3 | 3.7 |
| AD-1251296.1 | HsSCN9A_ORF1rp | 1 | 37.2 | 7.3 | 60.8 | 31.7 | 52.5 | 11.4 | 60.4 | 7.7 |
| AD-1251350.1 | HsSCN9A_ORF1rp | 1 | 28.0 | 2.9 | 29.3 | 3.3 | 36.9 | 4.9 | 67.8 | 7.3 |
| AD-1251351.1 | HsSCN9A_ORF1rp | 1 | 26.3 | 2.2 | 31.5 | 3.6 | 52.4 | 5.5 | 80.5 | 10.0 |
| AD-1251353.1 | HsSCN9A_ORF1rp | 1 | 25.4 | 0.8 | 26.4 | 5.8 | 39.2 | 5.0 | 60.7 | 4.0 |
| AD-1251352.1 | HsSCN9A_ORF1rp | 1 | 27.1 | 1.4 | 28.1 | 3.9 | 38.7 | 4.4 | 79.3 | 7.7 |
| AD-1251298.1 | HsSCN9A_ORF1rp | 1 | 58.5 | 11.3 | 34.5 | 6.3 | 61.7 | 6.7 | 61.1 | 3.2 |
| AD-1251297.1 | HsSCN9A_ORF1rp | 1 | 50.7 | 9.4 | 45.4 | 19.9 | 64.9 | 11.2 | 68.5 | 3.1 |
| AD-1251354.1 | HsSCN9A_ORF1rp | 1 | 25.6 | 3.7 | 25.2 | 4.1 | 36.5 | 3.5 | 61.3 | 10.9 |
| AD-1251355.1 | HsSCN9A_ORF1rp | 1 | 12.9 | 6.8 | 15.5 | 5.4 | 14.6 | 2.6 | 27.9 | 3.6 |
| AD-1251356.1 | HsSCN9A_ORF1rp | 1 | 21.4 | 6.6 | 30.9 | 2.2 | 21.2 | 13.2 | 45.7 | 5.6 |
| AD-1251357.1 | HsSCN9A_ORF1rp | 1 | 29.0 | 1.0 | 31.8 | 4.9 | 49.7 | 14.6 | 60.1 | 17.7 |
| AD-1251358.1 | HsSCN9A_ORF1rp | 1 | 19.3 | 1.3 | 26.5 | 6.7 | 52.1 | 6.5 | 76.8 | 36.1 |
| AD-1251359.1 | HsSCN9A_ORF1rp | 0 | 16.3 | 2.0 | 16.5 | 3.6 | 26.8 | 12.1 | 47.0 | 25.6 |
| AD-1251360.1 | HsSCN9A_ORF1rp | 0 | 23.5 | 2.1 | 23.0 | 3.3 | 33.2 | 9.9 | 62.8 | 5.0 |
| AD-1251361.1 | HsSCN9A_ORF1rp | 0 | 20.0 | 1.2 | 19.8 | 4.4 | 29.8 | 8.5 | 46.8 | 5.4 |
| AD-1251363.1 | HsSCN9A_ORF1rp | 0 | 9.4 | 3.0 | 10.9 | 1.9 | 14.7 | 2.8 | 34.0 | 12.5 |
| AD-1251362.1 | HsSCN9A_ORF1rp | 0 | 12.5 | 1.7 | 13.3 | 1.5 | 24.3 | 5.1 | 36.3 | 7.1 |
| AD-1251364.1 | HsSCN9A_ORF1rp | 1 | 12.5 | 4.1 | 14.8 | 1.7 | 11.8 | 6.0 | 25.0 | 1.5 |
| AD-1251372.1 | HsSCN9A_ORF1rp | 1 | 21.3 | 3.1 | 11.0 | 6.1 | 23.6 | 4.6 | 58.5 | 8.3 |
| AD-1251366.1 | HsSCN9A_ORF1rp | 1 | 14.5 | 0.6 | 13.8 | 3.9 | 25.6 | 3.5 | 62.5 | 3.0 |
| AD-1251367.1 | HsSCN9A_ORF1rp | 1 | 15.0 | 2.6 | 16.2 | 1.0 | 27.2 | 5.6 | 56.8 | 4.9 |
| AD-795634.4 | HsSCN9A_ORF1rp | 1 | 14.1 | 0.7 | 16.8 | 1.9 | 28.4 | 7.4 | 64.4 | 2.7 |
| AD-1251369.1 | HsSCN9A_ORF1rp | 2 | 19.5 | 0.8 | 17.4 | 2.7 | 20.9 | 6.9 | 41.7 | 11.7 |
| AD-1251368.1 | HsSCN9A_ORF1rp | 1 | 17.8 | 1.5 | 19.2 | 2.7 | 33.2 | 2.1 | 50.7 | 2.7 |
| AD-1251373.1 | HsSCN9A_ORF1rp | 1 | 25.3 | 1.3 | 22.3 | 2.8 | 30.5 | 15.1 | 42.5 | 22.0 |
| AD-1251365.1 | HsSCN9A_ORF1rp | 1 | 17.8 | 1.2 | 22.4 | 2.2 | 28.4 | 4.6 | 49.9 | 11.6 |

TABLE 17-continued

SCN9A in vitro multidose-dose screen with one set of exemplary human SCN9A siRNA duplexes (*the number following the decimal point in a duplex name merely refers to a batch production number)

| | | | 50 nM | | 10 nM | | 1 nM | | 0.1 nM | |
|---|---|---|---|---|---|---|---|---|---|---|
| Duplex | SC9NA | Mis-match | % message remaining | St. Dev. | % message remaining | St. Dev. | % message remaining | St. Dev. | % message remaining | St. Dev. |
| AD-1251370.1 | HsSCN9A_ORF1rp | 1 | 26.1 | 3.8 | 24.4 | 3.3 | 10.0 | 2.8 | 49.2 | 12.9 |
| AD-1251374.1 | HsSCN9A_ORF1rp | 1 | 23.6 | 4.5 | 27.5 | 6.8 | 20.9 | 9.6 | 69.2 | 12.6 |
| AD-1251375.1 | HsSCN9A_ORF1rp | 0 | 22.3 | 1.0 | 21.8 | 9.4 | 30.5 | 14.9 | 63.2 | 2.8 |
| AD-1251371.1 | HsSCN9A_ORF1rp | 1 | 29.4 | 2.4 | 27.1 | 2.4 | 25.0 | 6.3 | 65.7 | 8.7 |
| AD-1251376.1 | HsSCN9A_ORF1rp | 1 | 15.5 | 2.3 | 14.2 | 4.8 | 16.8 | 4.7 | 27.4 | 7.1 |
| AD-1251377.1 | HsSCN9A_ORF1rp | 1 | 10.7 | 6.8 | 15.6 | 2.6 | 10.1 | 3.8 | 22.6 | 5.2 |
| AD-1251378.1 | HsSCN9A_ORF1rp | 1 | 20.9 | 1.8 | 21.1 | 3.7 | 10.0 | 5.3 | 48.6 | 19.4 |
| AD-1251379.1 | HsSCN9A_ORF1rp | 1 | 39.1 | 4.1 | 42.8 | 3.2 | 53.8 | 8.1 | 96.8 | 2.1 |
| AD-1251380.1 | HsSCN9A_ORF1rp | 0 | 22.4 | 3.5 | 21.1 | 1.1 | 22.0 | 4.9 | 50.0 | 2.7 |
| AD-1251381.1 | HsSCN9A_ORF1rp | 0 | 22.0 | 1.9 | 22.1 | 2.9 | 32.0 | 8.8 | 51.8 | 2.8 |
| AD-1251382.1 | HsSCN9A_ORF1rp | 1 | 25.7 | 2.1 | 20.8 | 4.3 | 40.1 | 15.4 | 76.5 | 9.5 |
| AD-1251384.1 | HsSCN9A_ORF1rp | 1 | 15.0 | 0.8 | 11.8 | 4.4 | 20.7 | 1.8 | 40.7 | 1.4 |
| AD-1251274.2 | HsSCN9A_ORF1rp | 1 | 22.3 | 1.4 | 14.2 | 5.0 | 29.3 | 2.4 | 38.5 | 4.7 |
| AD-961188.3 | HsSCN9A_ORF1rp | 1 | 20.9 | 1.1 | 14.8 | 1.8 | 35.5 | 5.8 | 49.9 | 4.7 |
| AD-1251383.1 | HsSCN9A_ORF1rp | 1 | 16.6 | 2.2 | 14.8 | 3.3 | 27.8 | 6.5 | 47.5 | 6.1 |
| AD-1251269.1 | HsSCN9A_ORF1rp | 1 | 23.0 | 6.7 | 15.5 | 1.4 | 41.6 | 17.6 | 43.6 | 4.3 |
| AD-1251270.1 | HsSCN9A_ORF1rp | 1 | 22.1 | 2.9 | 16.8 | 4.6 | 47.0 | 8.0 | 60.8 | 4.2 |
| AD-1251268.1 | HsSCN9A_ORF1rp | 1 | 20.3 | 3.0 | 17.1 | 6.6 | 46.2 | 12.4 | 46.8 | 4.1 |
| AD-1251274.1 | HsSCN9A_ORF1rp | 1 | 16.9 | 3.7 | 17.9 | 6.9 | 34.3 | 5.2 | 104.5 | 47.1 |
| AD-1251271.1 | HsSCN9A_ORF1rp | 1 | 23.6 | 2.1 | 19.9 | 3.1 | 35.2 | 1.9 | 53.7 | 5.6 |
| AD-1251275.2 | HsSCN9A_ORF1rp | 1 | 23.0 | 4.1 | 26.0 | 7.7 | 54.8 | 20.9 | 51.3 | 2.6 |
| AD-1251275.1 | HsSCN9A_ORF1rp | 1 | 21.0 | 3.5 | 38.9 | 22.9 | 43.9 | 15.8 | 51.1 | 6.7 |
| AD-1251385.1 | HsSCN9A_ORF1rp | 1 | 8.9 | 3.7 | 9.4 | 4.8 | 11.9 | 6.0 | 30.3 | 5.2 |
| AD-1251272.1 | HsSCN9A_ORF1rp | 1 | 22.0 | 2.4 | 19.3 | 6.8 | 31.8 | 2.2 | 54.8 | 4.8 |
| AD-1251386.1 | HsSCN9A_ORF1rp | 0 | 24.8 | 2.7 | 26.0 | 2.1 | 27.1 | 13.8 | 47.2 | 17.2 |
| AD-1251273.1 | HsSCN9A_ORF1rp | 1 | 24.4 | 1.5 | 50.5 | 19.9 | 35.7 | 7.0 | 49.2 | 1.9 |
| AD-1251390.1 | HsSCN9A_ORF1rp | 1 | 23.4 | 1.8 | 13.0 | 4.8 | 37.9 | 11.8 | 59.5 | 9.9 |
| AD-1251398.1 | HsSCN9A_ORF1rp | 1 | 19.9 | 10.8 | 16.2 | 3.1 | 14.6 | 6.5 | 47.5 | 8.8 |
| AD-1251396.1 | HsSCN9A_ORF1rp | 1 | 23.8 | 1.5 | 17.1 | 4.6 | 31.1 | 8.8 | 55.7 | 3.6 |
| AD-1251399.1 | HsSCN9A_ORF1rp | 1 | 20.2 | 4.6 | 17.6 | 3.9 | 19.9 | 6.1 | 39.4 | 17.9 |
| AD-795913.3 | HsSCN9A_ORF1rp | 1 | 19.2 | 1.0 | 18.1 | 2.2 | 31.3 | 8.2 | 62.2 | 3.8 |
| AD-1251400.1 | HsSCN9A_ORF1rp | 1 | 22.4 | 3.4 | 19.1 | 2.1 | 29.6 | 14.6 | 58.7 | 5.9 |
| AD-1251388.1 | HsSCN9A_ORF1rp | 1 | 21.1 | 1.8 | 21.5 | 2.8 | 33.9 | 13.3 | 62.8 | 6.4 |
| AD-1251397.1 | HsSCN9A_ORF1rp | 1 | 30.5 | 2.0 | 24.4 | 12.3 | 51.6 | 11.2 | 63.9 | 12.3 |
| AD-1251395.1 | HsSCN9A_ORF1rp | 1 | 29.4 | 4.9 | 26.1 | 5.4 | 40.4 | 12.2 | 66.6 | 8.5 |
| AD-1251387.1 | HsSCN9A_ORF1rp | 1 | 27.9 | 1.4 | 28.4 | 3.1 | 43.0 | 18.2 | 80.9 | 9.0 |
| AD-1251389.1 | HsSCN9A_ORF1rp | 1 | 37.3 | 2.3 | 35.9 | 9.6 | 60.0 | 7.4 | 87.0 | 15.3 |
| AD-1251393.1 | HsSCN9A_ORF1rp | 1 | 39.6 | 2.8 | 41.8 | 6.2 | 60.0 | 21.7 | 105.3 | 8.9 |
| AD-1251394.1 | HsSCN9A_ORF1rp | 1 | 50.4 | 2.6 | 42.5 | 11.2 | 83.4 | 17.4 | 98.1 | 10.9 |
| AD-1251401.1 | HsSCN9A_ORF1rp | 1 | 59.1 | 3.9 | 46.0 | 9.7 | 51.5 | 22.8 | 77.7 | 15.2 |
| AD-1251391.1 | HsSCN9A_ORF1rp | 1 | 10.1 | 6.8 | 16.4 | 8.0 | 15.4 | 3.1 | 47.9 | 20.6 |
| AD-1251392.1 | HsSCN9A_ORF1rp | 1 | 22.9 | 2.8 | 20.8 | 5.9 | 21.1 | 5.7 | 71.0 | 16.2 |
| AD-1251402.1 | HsSCN9A_ORF1rp | 1 | 45.1 | 7.4 | 40.7 | 6.9 | 87.2 | 6.8 | 86.2 | 10.2 |
| AD-1251403.1 | HsSCN9A_ORF1rp | 1 | 35.1 | 2.3 | 31.3 | 3.4 | 47.0 | 8.7 | 62.7 | 3.4 |
| AD-1251404.1 | HsSCN9A_ORF1rp | 1 | 55.3 | 6.4 | 58.0 | 15.5 | 48.7 | 18.2 | 73.5 | 8.5 |
| AD-1251405.1 | HsSCN9A_ORF1rp | 1 | 22.8 | 2.4 | 25.5 | 5.8 | 25.1 | 12.5 | 37.4 | 19.6 |
| AD-1251406.1 | HsSCN9A_ORF2rp | 0 | 29.5 | 11.4 | 34.2 | 5.4 | 26.3 | 4.9 | 38.7 | 13.3 |
| AD-1251407.1 | HsSCN9A_ORF2rp | 1 | 26.6 | 2.6 | 26.2 | 2.1 | 43.8 | 8.8 | 63.4 | 16.8 |
| AD-1251408.1 | HsSCN9A_ORF2rp | 1 | 14.1 | 4.2 | 17.4 | 4.7 | 22.3 | 6.1 | 54.1 | 14.5 |
| AD-1251409.1 | HsSCN9A_ORF2rp | 0 | 17.7 | 2.5 | 17.5 | 5.5 | 28.9 | 7.3 | 55.6 | 9.0 |
| AD-1251411.1 | HsSCN9A_ORF2rp | 1 | 11.9 | 0.5 | 11.5 | 2.5 | 16.2 | 2.1 | 29.2 | 3.6 |
| AD-1251410.1 | HsSCN9A_ORF2rp | 1 | 12.0 | 2.1 | 11.7 | 2.9 | 17.7 | 2.5 | 29.6 | 7.2 |
| AD-1251412.1 | HsSCN9A_ORF2rp | 1 | 4.7 | 1.7 | 7.6 | 3.0 | 15.2 | 3.4 | 23.1 | 9.5 |
| AD-796825.3 | HsSCN9A_ORF2rp | 1 | 5.2 | 2.5 | 9.6 | 2.6 | 16.6 | 3.1 | 35.0 | 7.7 |
| AD-1251413.1 | HsSCN9A_ORF2rp | 1 | 14.2 | 2.9 | 12.0 | 1.9 | 26.6 | 7.3 | 46.9 | 4.2 |
| AD-1251414.1 | HsSCN9A_ORF2rp | 1 | 13.6 | 1.7 | 15.4 | 2.7 | 31.7 | 4.6 | 64.8 | 9.0 |
| AD-1251415.1 | HsSCN9A_ORF2rp | 1 | 13.5 | 0.7 | 15.9 | 2.4 | 23.0 | 3.6 | 51.2 | 6.1 |
| AD-1251416.1 | HsSCN9A_ORF2rp | 1 | 12.8 | 2.2 | 17.3 | 2.6 | 31.1 | 2.8 | 57.0 | 6.5 |
| AD-1251417.1 | HsSCN9A_ORF2rp | 0 | 11.3 | 2.4 | 13.5 | 3.9 | 23.6 | 2.2 | 42.4 | 10.3 |
| AD-1251418.1 | HsSCN9A_ORF2rp | 1 | 46.4 | 5.0 | 48.1 | 2.6 | 50.6 | 2.9 | 57.6 | 9.0 |
| AD-1251419.1 | HsSCN9A_ORF2rp | 1 | 8.7 | 1.3 | 12.9 | 1.4 | 23.0 | 2.3 | 27.2 | 3.2 |
| AD-1251420.1 | HsSCN9A_ORF2rp | 1 | 15.3 | 1.1 | 18.7 | 1.3 | 35.5 | 2.9 | 44.8 | 3.1 |
| AD-1251421.1 | HsSCN9A_ORF2rp | 1 | 16.5 | 1.2 | 18.2 | 2.7 | 32.3 | 4.0 | 56.2 | 6.1 |
| AD-1251422.1 | HsSCN9A_ORF2rp | 1 | 21.9 | 2.5 | 23.5 | 4.6 | 36.5 | 3.7 | 68.5 | 4.2 |
| AD-1251423.1 | HsSCN9A_ORF2rp | 1 | 48.6 | 3.7 | 45.7 | 3.8 | 62.7 | 3.8 | 84.1 | 8.5 |
| AD-1251425.1 | HsSCN9A_ORF2rp | 0 | 18.0 | 2.3 | 25.7 | 3.4 | 28.3 | 2.9 | 45.7 | 2.3 |
| AD-1251427.1 | HsSCN9A_ORF2rp | 1 | 18.5 | 2.3 | 22.0 | 1.3 | 29.6 | 1.3 | 42.5 | 3.1 |
| AD-1251426.1 | HsSCN9A_ORF2rp | 1 | 29.7 | 1.9 | 29.7 | 3.0 | 38.7 | 3.9 | 67.0 | 10.6 |
| AD-1251428.1 | HsSCN9A_ORF2rp | 1 | 12.5 | 0.8 | 17.5 | 1.9 | 23.6 | 0.1 | 30.9 | 3.4 |
| AD-797564.4 | HsSCN9A_ORF2rp | 1 | 21.2 | 3.5 | 23.9 | 6.1 | 39.4 | 2.3 | 69.2 | 7.9 |
| AD-1251434.1 | HsSCN9A_ORF2rp | 1 | 16.3 | 1.0 | 25.1 | 4.2 | 34.4 | 3.1 | 39.1 | 2.5 |
| AD-1251431.1 | HsSCN9A_ORF2rp | 2 | 21.3 | 3.5 | 27.4 | 5.5 | 34.6 | 5.4 | 62.8 | 3.1 |

TABLE 17-continued

SCN9A in vitro multidose-dose screen with one set of exemplary human SCN9A siRNA duplexes (*the number following the decimal point in a duplex name merely refers to a batch production number)

| | | | 50 nM | | 10 nM | | 1 nM | | 0.1 nM | |
|---|---|---|---|---|---|---|---|---|---|---|
| Duplex | SC9NA | Mis-match | % message remaining | St. Dev. | % message remaining | St. Dev. | % message remaining | St. Dev. | % message remaining | St. Dev. |
| AD-1251433.1 | HsSCN9A_ORF2rp | 1 | 22.1 | 6.3 | 28.4 | 2.7 | 39.3 | 2.2 | 48.6 | 7.5 |
| AD-1251430.1 | HsSCN9A_ORF2rp | 1 | 32.1 | 3.3 | 30.9 | 4.2 | 49.6 | 7.5 | 81.5 | 6.4 |
| AD-1251429.1 | HsSCN9A_ORF2rp | 1 | 30.0 | 4.6 | 33.3 | 9.9 | 52.0 | 3.4 | 92.1 | 4.8 |
| AD-1251435.1 | HsSCN9A_ORF2rp | 1 | 34.9 | 6.3 | 47.8 | 8.5 | 58.1 | 7.4 | 93.2 | 14.2 |
| AD-1251438.1 | HsSCN9A_ORF2rp | 1 | 20.1 | 3.8 | 25.1 | 5.2 | 35.5 | 3.8 | 55.5 | 2.9 |
| AD-1251436.1 | HsSCN9A_ORF2rp | 1 | 25.0 | 3.0 | 33.4 | 11.1 | 47.7 | 9.8 | 86.2 | 24.0 |
| AD-1251437.1 | HsSCN9A_ORF2rp | 1 | 24.6 | 3.9 | 34.4 | 3.9 | 41.8 | 7.1 | 65.3 | 7.3 |
| AD-797565.4 | HsSCN9A_ORF2rp | 1 | 28.2 | 6.0 | 39.3 | 8.0 | 54.4 | 0.0 | 76.1 | 7.2 |
| AD-1251443.1 | HsSCN9A_ORF2rp | 1 | 43.2 | 4.4 | 52.4 | 3.6 | 63.0 | 4.0 | 94.7 | 10.5 |
| AD-1251444.1 | HsSCN9A_ORF2rp | 1 | 39.3 | 7.9 | 54.5 | 13.1 | 59.8 | 14.9 | 72.2 | 9.9 |
| AD-1251442.1 | HsSCN9A_ORF2rp | 1 | 44.2 | 5.8 | 61.1 | 9.7 | 76.8 | 8.9 | 102.9 | 5.6 |
| AD-1251441.1 | HsSCN9A_ORF2rp | 1 | 51.0 | 10.9 | 71.0 | 14.2 | 78.9 | 12.0 | 119.7 | 14.5 |
| AD-1251445.1 | HsSCN9A_ORF2rp | 0 | 56.7 | 7.7 | 57.9 | 1.8 | 84.7 | 14.2 | 101.1 | 18.9 |
| AD-1251439.1 | HsSCN9A_ORF2rp | 1 | 21.7 | 4.1 | 30.7 | 2.6 | 35.2 | 0.3 | 49.0 | 4.9 |
| AD-1251447.1 | HsSCN9A_ORF2rp | 0 | 34.1 | 3.4 | 32.8 | 4.6 | 47.4 | 1.8 | 77.8 | 6.3 |
| AD-1251446.1 | HsSCN9A_ORF2rp | 0 | 29.8 | 4.3 | 34.6 | 0.9 | 46.9 | 9.3 | 64.0 | 8.0 |
| AD-1251448.1 | HsSCN9A_ORF2rp | 1 | 21.7 | 3.3 | 24.6 | 3.4 | 36.2 | 2.3 | 57.2 | 8.1 |
| AD-1251450.1 | HsSCN9A_ORF2rp | 1 | 45.4 | 5.5 | 64.0 | 8.0 | 80.5 | 11.1 | 90.5 | 5.5 |
| AD-1251449.1 | HsSCN9A_ORF2rp | 1 | 39.5 | 1.9 | 66.5 | 8.8 | 70.0 | 13.7 | 79.7 | 8.7 |
| AD-1251451.1 | HsSCN9A_ORF2rp | 1 | 151.3 | 26.1 | 173.5 | 16.6 | 134.6 | 12.6 | 112.4 | 20.9 |
| AD-1251453.1 | HsSCN9A_3UTR2 | 1 | 63.7 | 11.4 | 79.2 | 7.3 | 88.9 | 12.9 | 94.1 | 6.4 |
| AD-1251452.1 | HsSCN9A_3UTR2 | 1 | 71.3 | 4.8 | 81.2 | 9.3 | 85.0 | 10.8 | 82.6 | 5.4 |
| AD-1251454.1 | HsSCN9A_3UTR2 | 1 | 63.5 | 13.3 | 79.3 | 9.2 | 75.8 | 9.3 | 97.6 | 6.8 |
| AD-1251455.1 | HsSCN9A_3UTR2 | 1 | 51.7 | 9.1 | 46.1 | 4.9 | 63.5 | 3.0 | 80.6 | 2.1 |
| AD-1251456.1 | HsSCN9A_3UTR2 | 1 | 64.3 | 6.0 | 90.5 | 11.6 | 78.4 | 4.2 | 101.9 | 20.7 |
| AD-1251457.1 | HsSCN9A_3UTR2 | 1 | 79.1 | 14.7 | 110.0 | 9.9 | 115.5 | 20.4 | 112.2 | 12.8 |
| AD-1251459.1 | HsSCN9A_3UTR2 | 1 | 67.9 | 17.2 | 95.3 | 3.1 | 98.0 | 8.5 | 98.4 | 13.2 |
| AD-1251458.1 | HsSCN9A_3UTR2 | 1 | 65.7 | 8.9 | 96.7 | 5.2 | 89.7 | 8.1 | 92.6 | 19.5 |
| AD-1251462.1 | HsSCN9A_3UTR2 | 0 | 53.7 | 11.0 | 45.4 | 8.0 | 69.1 | 7.1 | 92.5 | 10.8 |
| AD-1251461.1 | HsSCN9A_3UTR2 | 0 | 39.5 | 4.4 | 52.2 | 9.5 | 52.4 | 10.0 | 73.4 | 7.2 |
| AD-1251468.1 | HsSCN9A_3UTR2 | 0 | 57.2 | 11.7 | 69.7 | 6.9 | 69.9 | 27.8 | 96.3 | 13.0 |
| AD-1251463.1 | HsSCN9A_3UTR2 | 0 | 59.0 | 6.0 | 71.0 | 7.3 | 76.1 | 25.4 | 84.5 | 0.7 |
| AD-1251460.1 | HsSCN9A_3UTR2 | 0 | 51.7 | 11.9 | 76.8 | 8.3 | 73.0 | 13.5 | 78.6 | 10.6 |
| AD-1251469.1 | HsSCN9A_3UTR2 | 0 | 58.2 | 6.4 | 80.9 | 6.3 | 86.4 | 9.0 | 93.7 | 7.8 |
| AD-801647.3 | HsSCN9A_3UTR2 | 0 | 64.5 | 11.9 | 83.8 | 8.1 | 78.4 | 5.2 | 80.1 | 7.9 |
| AD-1251467.1 | HsSCN9A_3UTR2 | 0 | 56.8 | 15.2 | 100.9 | 15.2 | 104.8 | 8.8 | 86.3 | 15.7 |
| AD-1251466.1 | HsSCN9A_3UTR2 | 0 | 72.3 | 18.5 | 105.2 | 10.0 | 112.2 | 10.3 | 113.0 | 13.4 |
| AD-1251470.1 | HsSCN9A_3UTR2 | 1 | 44.9 | 7.9 | 52.3 | 9.7 | 61.4 | 3.7 | 63.6 | 4.1 |
| AD-1251471.1 | HsSCN9A_3UTR2 | 1 | 51.3 | 2.7 | 69.5 | 5.1 | 54.2 | 3.3 | 80.1 | 11.2 |
| AD-1251465.1 | HsSCN9A_3UTR2 | 0 | 66.1 | 11.7 | 76.8 | 7.3 | 84.5 | 9.8 | 94.9 | 20.2 |
| AD-1251472.1 | HsSCN9A_3UTR2 | 1 | 86.2 | 4.2 | 98.3 | 12.9 | 76.8 | 8.6 | 109.5 | 6.7 |
| AD-1251464.1 | HsSCN9A_3UTR2 | 0 | 77.4 | 9.8 | 108.6 | 13.9 | 115.7 | 4.2 | 106.4 | 8.1 |
| AD-1251473.1 | HsSCN9A_3UTR2 | 0 | 57.3 | 1.8 | 68.9 | 6.8 | 76.5 | 6.6 | 84.0 | 8.0 |
| AD-1251474.1 | HsSCN9A_3UTR2 | 0 | 57.4 | 9.3 | 74.5 | 4.4 | 71.6 | 7.7 | 84.8 | 1.6 |
| AD-1251475.1 | HsSCN9A_3UTR2 | 1 | 57.3 | 6.3 | 64.7 | 8.7 | 70.6 | 9.1 | 80.0 | 9.0 |
| AD-1251476.1 | HsSCN9A_3UTR2 | 1 | 55.1 | 8.6 | 88.3 | 7.1 | 79.4 | 6.6 | 90.9 | 18.5 |
| AD-1251279.1 | HsSCN9A_3UTR2 | 0 | 41.1 | 2.9 | 30.9 | 2.1 | 38.7 | 4.8 | 46.6 | 2.3 |
| AD-1251276.1 | HsSCN9A_3UTR2 | 0 | 39.0 | 7.0 | 33.4 | 11.2 | 49.1 | 7.2 | 54.6 | 8.2 |
| AD-1251280.1 | HsSCN9A_3UTR2 | 0 | 43.9 | 2.9 | 41.1 | 13.8 | 43.0 | 4.2 | 46.3 | 3.9 |
| AD-1251277.1 | HsSCN9A_3UTR2 | 0 | 42.6 | 6.4 | 47.0 | 24.3 | 51.8 | 8.4 | 52.3 | 4.9 |
| AD-961334.3 | HsSCN9A_3UTR2 | 0 | 52.6 | 8.4 | 68.4 | 20.0 | 52.5 | 7.6 | 59.3 | 5.8 |
| AD-1251278.1 | HsSCN9A_3UTR2 | 0 | 36.6 | 3.1 | 45.6 | 20.8 | 44.7 | 4.7 | 47.2 | 2.1 |
| AD-1251477.1 | HsSCN9A_3UTR2 | 1 | 46.1 | 17.5 | 58.6 | 8.4 | 90.9 | 1.7 | 93.4 | 12.8 |
| AD-1251478.1 | HsSCN9A_3UTR2 | 1 | 78.6 | 3.2 | 82.8 | 1.1 | 77.7 | 8.7 | 112.7 | 15.5 |
| AD-1251479.1 | HsSCN9A_3UTR2 | 0 | 81.1 | 10.6 | 103.1 | 8.9 | 91.1 | 9.8 | 115.5 | 10.6 |
| AD-1251481.1 | HsSCN9A_3UTR2 | 1 | 65.0 | 4.7 | 76.1 | 9.1 | 73.4 | 3.7 | 98.6 | 9.3 |
| AD-1251480.1 | HsSCN9A_3UTR2 | 1 | 69.5 | 4.9 | 76.6 | 2.6 | 88.1 | 8.3 | 117.5 | 12.9 |
| AD-1251482.1 | HsSCN9A_3UTR2 | 1 | 60.8 | 2.9 | 65.6 | 13.3 | 72.6 | 8.4 | 91.2 | 14.0 |
| AD-1251483.1 | HsSCN9A_3UTR2 | 1 | 62.5 | 12.5 | 75.6 | 7.9 | 75.4 | 6.0 | 91.5 | 12.7 |
| AD-1251492.1 | HsSCN9A_3UTR2 | 0 | 22.3 | 2.6 | 29.1 | 3.3 | 33.3 | 3.4 | 52.8 | 7.6 |
| AD-1251485.1 | HsSCN9A_3UTR2 | 0 | 27.9 | 3.7 | 33.9 | 7.3 | 41.4 | 5.4 | 56.2 | 6.4 |
| AD-802471.4 | HsSCN9A_3UTR2 | 0 | 38.5 | 4.6 | 39.0 | 5.3 | 57.9 | 8.0 | 82.7 | 17.2 |
| AD-1251486.1 | HsSCN9A_3UTR2 | 0 | 38.5 | 2.8 | 39.8 | 8.1 | 51.6 | 4.4 | 78.1 | 11.1 |
| AD-1251484.1 | HsSCN9A_3UTR2 | 0 | 33.7 | 2.8 | 39.9 | 9.1 | 72.9 | 27.3 | 76.1 | 3.9 |
| AD-1251491.1 | HsSCN9A_3UTR2 | 0 | 33.7 | 7.5 | 45.6 | 5.7 | 48.4 | 6.8 | 61.9 | 11.3 |
| AD-1251487.1 | HsSCN9A_3UTR2 | 0 | 46.0 | 7.1 | 50.1 | 12.4 | 61.6 | 10.6 | 82.9 | 8.4 |
| AD-1251488.1 | HsSCN9A_3UTR2 | 0 | 47.9 | 6.4 | 52.1 | 6.6 | 57.2 | 8.0 | 82.0 | 7.7 |
| AD-1251490.1 | HsSCN9A_3UTR2 | 0 | 46.5 | 12.0 | 53.9 | 17.4 | 52.6 | 4.1 | 79.0 | 5.3 |
| AD-1251494.1 | HsSCN9A_3UTR2 | 1 | 51.7 | 6.1 | 42.6 | 2.8 | 51.8 | 7.3 | 80.5 | 5.4 |
| AD-1251493.1 | HsSCN9A_3UTR2 | 0 | 28.2 | 1.2 | 30.4 | 2.3 | 38.7 | 3.8 | 53.6 | 2.8 |
| AD-1251489.1 | HsSCN9A_3UTR2 | 0 | 38.9 | 4.4 | 54.3 | 8.1 | 59.3 | 13.6 | 83.7 | 16.5 |
| AD-1251495.1 | HsSCN9A_3UTR2 | 1 | 67.8 | 6.5 | 58.8 | 3.1 | 68.8 | 14.7 | 77.6 | 25.9 |

TABLE 17-continued

SCN9A in vitro multidose-dose screen with one set of exemplary human SCN9A siRNA duplexes (*the number following the decimal point in a duplex name merely refers to a batch production number)

| | | | 50 nM | | 10 nM | | 1 nM | | 0.1 nM | |
|---|---|---|---|---|---|---|---|---|---|---|
| Duplex | SC9NA | Mis-match | % message remaining | St. Dev. | % message remaining | St. Dev. | % message remaining | St. Dev. | % message remaining | St. Dev. |
| AD-1251496.1 | HsSCN9A_3UTR2 | 1 | 61.6 | 7.8 | 48.6 | 5.8 | 64.2 | 7.1 | 78.7 | 7.9 |
| AD-1251497.1 | HsSCN9A_3UTR2 | 1 | 78.9 | 10.4 | 71.3 | 9.4 | 67.7 | 5.5 | 93.1 | 6.0 |
| AD-1251498.1 | HsSCN9A_3UTR2 | 1 | 91.0 | 6.2 | 79.9 | 14.1 | 79.0 | 11.5 | 89.1 | 10.4 |
| AD-802552.3 | HsSCN9A_3UTR2 | 0 | 45.8 | 3.9 | 31.8 | 4.5 | 60.8 | 9.9 | 51.1 | 3.4 |
| AD-1251267.1 | HsSCN9A_3UTR2 | 0 | 44.9 | 2.7 | 32.2 | 2.1 | 48.4 | 2.2 | 55.7 | 3.8 |
| AD-1251260.1 | HsSCN9A_3UTR2 | 0 | 48.1 | 7.6 | 33.0 | 6.6 | 59.5 | 10.8 | 58.4 | 1.8 |
| AD-1251256.1 | HsSCN9A_3UTR2 | 0 | 42.3 | 4.0 | 33.6 | 8.3 | 47.5 | 3.2 | 52.8 | 3.1 |
| AD-1251265.1 | HsSCN9A_3UTR2 | 0 | 50.9 | 6.8 | 34.5 | 10.1 | 60.0 | 16.7 | 58.4 | 4.3 |
| AD-1251257.1 | HsSCN9A_3UTR2 | 0 | 50.0 | 5.2 | 40.8 | 7.9 | 50.1 | 4.1 | 65.8 | 11.6 |
| AD-1251266.1 | HsSCN9A_3UTR2 | 0 | 52.4 | 7.1 | 41.8 | 6.8 | 58.0 | 5.5 | 70.0 | 16.1 |
| AD-1251264.1 | HsSCN9A_3UTR2 | 1 | 49.2 | 3.0 | 47.6 | 11.3 | 64.5 | 5.4 | 71.7 | 10.0 |
| AD-1251259.1 | HsSCN9A_3UTR2 | 0 | 49.0 | 4.7 | 48.9 | 23.0 | 49.1 | 3.1 | 64.4 | 1.8 |
| AD-1251258.1 | HsSCN9A_3UTR2 | 0 | 47.3 | 8.8 | 54.9 | 42.4 | 52.1 | 7.1 | 52.7 | 4.2 |
| AD-1251263.1 | HsSCN9A_3UTR2 | 0 | 30.4 | 1.6 | 22.8 | 4.0 | 67.4 | 15.5 | 71.5 | 24.2 |
| AD-1251262.1 | HsSCN9A_3UTR2 | 0 | 45.1 | 3.6 | 30.5 | 4.3 | 57.8 | 3.6 | 57.4 | 1.7 |
| AD-1251261.1 | HsSCN9A_3UTR2 | 0 | 43.1 | 5.3 | 34.1 | 10.0 | 47.5 | 5.0 | 51.5 | 4.8 |

Example 4. In Vivo Screening of SCN9A siRNA

Experimental Methods

Wildtype B6/C57 mice (Charles Rivers Laboratory) were retro-orbitally injected with human SCN9A constructs designed to span various regions of human SCN9A (e.g., the 3' UTR_AAV1 (positions 6266 to 7998), 3'UTR-AAV2 (positions 7999 to 9750) and two open reading frames (ORF-1 (positions 299 to 2441) or ORF-2 (positions 2392 to 4354)) packaged in AAV particles ($2\times10^{10}$ gc/mouse). After two weeks, mice were injected subcutaneously with 3 mg/kg of exemplary siRNAs (C16, VCP, or GalNAc) (Tables 4A, 5A, 6A, 18 (also summarized in FIGS. 1A-1C) or 20 (also summarized in FIGS. 3A-3D), or a PBS or non-targeting siRNA control (Table 9). On day 14 post-treatment, livers were harvested for qPCR analysis with a probe specifically recognizing SCN9A. Mouse GAPDH was used as normalization control. Relative levels of SCN9A mRNA in the liver were calculated with the delta/delta Ct method, normalized to the control groups, and is depicted as the percent message remaining in Tables 10-12, 19, and 21 below.

TABLE 9

Control siRNA Sequences

| Duplex Name | Target | Strand | Seq ID No: (modified) | Modified Sequences | Seq ID No: (unmodified) | Unmodified Sequences |
|---|---|---|---|---|---|---|
| AD-64228.39 | none | Sense | 3695 | asascaguGfuUfCfUfugcucuauaaL96 | 3696 | AACAGUGUUCUUGCUCUAUAA |
| AD-86460 | mTTR | Antisense | 3697 | usUfsauaGfaGfCfaagaAfcAfcuguususu | 3698 | UUAUAGAGCAAGAACACUGUUUU |

TABLE 18

Exemplary SCN9A duplexes investigated and corresponding chemistry that target ORF-1 of SCN9A (e.g., positions 299-2441). In this table the column "Duplex Name" provides the numerical part of the duplex name with a suffix (number following the decimal point in a duplex name) that merely refers to a batch production number. The suffix can be omitted from the duplex name without changing the chemical structure.

| Duplex Name | Strand | SEQ ID NO: | Modified Sequence |
|---|---|---|---|
| AD-795305.2 | sense | 5330 | usgsucg(Ahd)GfuAfCfAfcuuuuacugaL96 |
| (parent) | anti-sense | 5346 | VPusCfsaguAfaAfAfguguAfcUfcgacasusu |
| AD-1251249.1 | sense | 5331 | usgsucgaguAfCfAfcuuu(Uhd)acugaL96 |
| | anti-sense | 5347 | VPusCfsagdTadAaaguguAfcUfcgacasusu |
| AD-1251251.1 | sense | 5332 | uscsgaguAfCfAfcuuu(Uhd)acugaL96 |
| | anti-sense | 5348 | VPusCfsagdTadAaaguguAfcUfcgascsg |
| AD-1010663.2 | sense | 5333 | usgsuag(Ghd)agdAadTucacuuuucaL96 |
| (parent) | anti-sense | 5349 | VPusdGsaadAadGugaadTudCudCcuacascsa |
| AD-1251301.1 | sense | 5334 | usgsuaggagdAaUfUfcac(Uhd)uuucaL96 |
| | anti-sense | 5350 | VPudGaadAa(G2p)ugaadTudCudCcuacascsg |
| AD-961179.3 | sense | 5335 | asasggg(Ahd)aadAcdAaucuuccguaL96 |
| (parent) | anti-sense | 5351 | VPusdAscgdGadAgauudGudTudTcccuususg |
| AD-1251317.1 | sense | 5336 | asasgggaaaAfCfAfaucu(Uhd)ccguaL96 |
| | anti-sense | 5352 | VPudAcgdGa(A2p)gauudGuUfudTcccuususg |
| AD-1251318.1 | sense | 5337 | asgsggaaAfaCfAfAfucuu(Chd)cguuaL96 |
| | anti-sense | 5353 | VPusAfsacdGgdAagauugUfuUfucccususu |
| AD-1251323.1 | sense | 5338 | gsasaaa(Chd)aaUfCfUfuccguuucaaL96 |
| | anti-sense | 5354 | VPuUfgadAa(C2p)ggaagaUfudGuuuucscsc |
| AD-1251325.1 | sense | 5339 | asasaacaauCfUfUfccgu(Uhd)ucaaaL96 |
| | anti-sense | 5355 | VPuUfugdAadAcggadAgdAuUfguuuuscsc |
| AD-795634.3 | sense | 5340 | asgscau(Ahd)AfaUfGfUfuuucgaaauaL96 |
| (parent) | anti-sense | 5356 | VPusAfsuuuCfgAfAfaacaUfuUfaugcususc |
| AD-1251363.1 | sense | 5341 | gsasagcauadAaUfguuu(Uhd)cgaaaL96 |
| | anti-sense | 5357 | VPuUfucdGadAaacadTuUfaUfgcuucsasg |
| AD-1251364.1 | sense | 5342 | asasgca(Uhd)aadAudGuuuucgaaaaL96 |
| | anti-sense | 5358 | VPuUfuudCgdAaaacdAuUfudAugcuuscsg |
| AD-1251373.1 | sense | 5343 | asgscauaaaUfgUfuuu(Chd)gaaauaL96 |
| | anti-sense | 5359 | VPudAuudTc(G2p)aaaadCaUfuUfaugcuscsc |
| AD-1251385.1 | sense | 5344 | asusgau(Chd)UfuCfUfUfugucguaguaL96 |
| (parent: AD-795913) | anti-sense | 5360 | VPudAcudAcdGacaadAgdAadGaucausgsu |
| AD-1251391.1 | sense | 5345 | uscsu(Uhd)CfuUfudGucguagugaaL96 |
| (parent: AD-795913) | anti-sense | 5361 | VPusUfscadCu(Agn)cgacdAaAfgAfagasusc |

TABLE 20

Exemplary SCN9A duplexes investigated and corresponding chemistry that target region 2 of the 3' UTR of SCN9A (HsSCN9A_3UTR2, e.g., positions 7999 to 9750), ORF-1 of SCN9A (HsSCN9A_ORF1rp, e.g., positions 299-2441), and ORF2 of SCN9A (HsSCN9A_ORF2rp, e.g., positions 2392-4345). In this table the column "Duplex Name" provides the numerical part of the duplex name with a suffix (number following the decimal point in a duplex name) production number. The suffix can be omitted from the duplex name without changing the that merely refers to a batch chemical structure.

| AAV | Duplex Name | Strand | SEQ ID NO: | Modified Sequence | Parent |
|---|---|---|---|---|---|
| HsSCN9A_3UTR2 | AD-1251492.2 | sense | 5410 | csasagugUfuCfCfUfacug(Uhd)caugaL96 | AD-802471 |
| | | anti-sense | 5426 | VPuCfaudGa(C2p)aguaggAfaCfacuugscsc | |
| | AD-961334.2 | sense | 5411 | csasaca(Chd)aadTudTcuucuuagcaL96 | Self |
| | (Parent) | anti-sense | 5427 | VPusdGscudAadGaagadAadTudGuguugsusu | |
| | AD-1251279.2 | sense | 5412 | csasaca(Chd)aaufUfUfcuucuuagcaL96 | AD-961334 |
| | | anti-sense | 5428 | VPudGcudAadGaagadAaufudGuguugsusu | |
| HsSCN9A_ORF1rp | AD-1251284.2 | sense | 5413 | usgsucgaguAfCfAfcuuu(Uhd)acugaL96 | AD-1010661 |
| | | anti-sense | 5429 | VPusCfsagdTadAaagudGuAfcdTcgacasusu | |
| | AD-1251334.2 | sense | 5414 | usu

scug(Uhd)guAfgdGagaauucacaL96 | AD-795366 |
| | | anti-sense | 5430 | VPusdGsugdAa(U2p)ucucdCuAfcAfcagaasgsc | |
| | AD-1251377.2 | sense | 5415 | asusaaa(Uhd)guUfUfUfcgaaauucaaL96 | AD-795634 |
| | | anti-sense | 5431 | VPusufsgadAudTucgaaaAfcAfuuuausgsu | |
| | AD-1251398.2 | sense | 5416 | gsasucu(Uhd)CfuUfudGucguagugaaL96 | AD-795913 |
| | | anti-sense | 5432 | VPuufcadCu(A2p)cgacdAaAfgAfagaucsgsu | |
| | AD-1251399.2 | sense | 5417 | gsasucu(Uhd)CfuUfudGUfcguagugaaL96 | AD-795913 |
| | | anti-sense | 5433 | VPuufcadCu(A2p)cgacdAaAfgAfagaucsgsu | |
| | AD-961188.2 | sense | 5418 | csasuga(Uhd)cudTcdTuugucguagaL96 | Self |
| | (Parent) | anti-sense | 5434 | VPusdCsuadCgdAcaaadGadAgdAucaugsusa | |
| | AD-1251274.3 | sense | 5419 | csasuga(Uhd)cuufCfUfuugucguagaL96 | AD-961188 |
| | | anti-sense | 5435 | VPuCfuadCgdAcaaadGadAgdAucaugsusg | |
| HsSCN9A_ORF2rp | AD-796825.2 | sense | 5420 | ususugu(Ahd)GfaufCfUfugcaauuacaL96 | Self |
| | (Parent) | anti-sense | 5436 | VPusGfsuaaUfuGfCfaagaUfcUfacaaasasg | |
| | AD-1251411.2 | sense | 5421 | ususuug(Uhd)agAfUfCfuugcaauuaaL96 | AD-796825 |
| | | anti-sense | 5437 | VPusufsaadTu(G2p)caagauCfuAfcaaagscsc | |
| | AD-1251419.2 | sense | 5422 | gsusaga(Uhd)CfuufgCfaauuaccauaL96 | AD-796825 |
| | | anti-sense | 5438 | VPudAugdGudAauugdCaAfgAfucuacsgsg | |
| | AD-797564.3 | sense | 5423 | usasugu(Ghd)AfaAfCfAfaaccuuacgaL96 | Self |
| | (Parent) | anti-sense | 5439 | VPusCfsguaAfgGfUfuuguUfuCfacauasasu | |
| | AD-1251428.2 | sense | 5424 | ususaug(Uhd)gaAfAfCfaaaccuuacaL96 | AD-1251428 |
| | | anti-sense | 5440 | VPudGuadAg(G2p)uuuguuufcAfcauaasusu | |
| | AD-1251434.2 | sense | 5425 | usasugugAfaAfCfAfaacc(Uhd)uacgaL96 | AD-1251428 |
| | | anti-sense | 5441 | VPuCfgudAa(G2p)guuuguUfuCfacauasgsu | |

Results

Table 10 (siRNA duplexes correspond to siRNA sequences in Tables 4A and 5A) demonstrates the results of the in vivo screen for the ORF-1 targeting duplexes, and includes siRNA duplexes with Fluoro and Non-Fluoro chemistries. Of the siRNA duplexes evaluated in the in vivo screen shown in Table 10, 1 achieved ≥80% knockdown of SCN9A, 8 achieved ≥60% knockdown of SCN9A, 13 achieved ≥40% knockdown of SCN9A, and 15 achieved ≥20% knockdown of SCN9A.

TABLE 10

| | Efficacy and duration of exemplary ORF-1 targeting SCN9A siRNAs in mice | | | |
|---|---|---|---|---|
| Treatment* | SEQ ID NO Sense/Antisense | Chemistry | % message remaining at day 14 post-treatment | St. Dev. |
| PBS | | N/A | 100.00 | 19.46 |
| Naïve (AAV-only) | | | 115.79 | 22.37 |
| AD-64228.39 (AAV-control) | 3695/3696 | Fluoro | 59.06 | 27.45 |
| AD-961179.2 | 5335/5351 | NonFluoro | 20.49 | 0.95 |
| AD-795305.2 | 5330/5346 | Fluoro | 21.96 | 5.16 |
| AD-1010661.2 | 4033/4299 | NonFluoro | 41.08 | 6.19 |
| AD-795366.2 | 4052/4318 | Fluoro | 29.15 | 4.74 |
| AD-1010662.2 | 2505/2595 | NonFluoro | 52.17 | 4.57 |
| AD-795371.2 | 4065/4331 | Fluoro | 16.30 | 6.34 |
| AD-1010663.2 | 5333/5349 | NonFluoro | 21.60 | 1.20 |
| AD-795634.3 | 5340/5356 | Fluoro | 20.80 | 6.50 |
| AD-795739.2 | 1813/1814 | Fluoro | 41.18 | 10.45 |
| AD-1010664.2 | 2521/2611 | NonFluoro | 71.93 | 4.59 |
| AD-961188.2 | 5418/5434 | NonFluoro | 38.51 | 0.36 |

TABLE 10-continued

| | Efficacy and duration of exemplary ORF-1 targeting SCN9A siRNAs in mice | | | |
|---|---|---|---|---|
| Treatment* | SEQ ID NO Sense/Antisense | Chemistry | % message remaining at day 14 post-treatment | St. Dev. |
| AD-961189.2 | 2509/2599 | NonFluoro | 55.25 | 14.04 |
| AD-795913.2 | 4136/4402 | Fluoro | 26.74 | 5.61 |
| AD-795914.2 | 1811/1812 | Fluoro | 76.20 | 11.80 |
| AD-961192.2 | 2515/1605 | NonFluoro | 104.26 | 12.37 |
| AD-1010671.2 | 2510/2600 | NonFluoro | 98.29 | 17.97 |
| AD-796618.2 | 1809/1810 | Fluoro | 57.42 | 1.30 |

(*the number following the decimal point in a duplex name merely refers to a batch production number)

Table 11 (siRNA duplexes correspond to siRNA sequences in Tables 4A, 5A, and 6A) demonstrates the results of the in vivo screen for the ORF-2-targeting duplexes as well as the 3'UTR_AAV1 and 3'UTR_AAV2 targeting duplexes and includes siRNA duplexes with Fluoro, Non-Fluoro, Fluoro+GNA chemistries. Of the ORF-2 targeting siRNA duplexes evaluated in the in vivo screen shown in Table 11, 3 achieved ≥80% knockdown of SCN9A, 4 achieved ≥30% knockdown of SCN9A, and 5 achieved ≥20% knockdown of SCN9A. Of the 3'UTR_AAV1 targeting siRNA duplexes (positions 6266 to 7998) evaluated in this screen shown in Table 11, 2 achieved ≥20% knockdown of SCN9A. Of the 3'UTR_AAV2 targeting siRNA duplexes (positions 7999 to 9750) evaluated in this screen shown in Table 11, 2 achieved ≥60% knockdown of SCN9A, and 5 achieved ≥30% knockdown of SCN9A.

TABLE 11

| | | Efficacy and duration of exemplary ORF-2 and 3'UTR targeting SCN9A siRNAs in mice | | | |
|---|---|---|---|---|---|
| AAV | SEQ ID NO Sense/Antisense | Treatment* | Chemistry | % message remaining at day 14 post-treatment | St. Dev. |
| HsSCN9A_ORF2rp | | PBS | n/a | 100.00 | 13.04 |
| | | naïve (AAV-only) | | 96.31 | 19.26 |
| | 5420/5436 | AD-796825.1 | Fluoro | 12.49 | 2.90 |
| | 2504/2594 | AD-961207.1 | NonFluoro | 71.01 | 17.81 |
| | 2503/2593 | AD-961208.1 | NonFluoro | 66.66 | 10.33 |
| | 1803/1804 | AD-797564.2 | Fluoro | 13.59 | 5.19 |
| | 1799/1800 | AD-797565.2 | Fluoro | 12.26 | 1.86 |
| 3'UTR_AAV1 | | PBS | n/a | 100.00 | 21.53 |
| | | naïve (AAV-only) | | 117.95 | 19.80 |
| | 1857/1858 | AD-800819.1 | Fluoro | 79.02 | 5.13 |
| | 2517/2607 | AD-1010693.1 | NonFluoro | 70.89 | 9.77 |
| 3'UTR_AAV2 | | PBS | n/a | 100.00 | 28.24 |
| | | naïve (AAV-only) | | 114.62 | 35.06 |
| | 1865/1866 | AD-802503.1 | Fluoro | 50.95 | 7.80 |
| | 1873/1874 | AD-802552.1 | Fluoro | 31.59 | 5.19 |
| | 5829/5918 | AD-1002101.1 | Fluoro + GNA | 55.04 | 23.31 |
| | 1883/1884 | AD-802625.2 | Fluoro | 47.78 | 4.47 |
| | 1893/1894 | AD-802853.2 | Fluoro | 35.44 | 5.41 |

(*the number following the decimal point in a duplex name merely refers to a batch production number)

Table 12 (siRNA duplexes correspond to siRNA sequences in Tables 4A, 5A, and 6A) demonstrates the results of the in vivo screen for 3'UTR AAV2 targeting siRNA duplexes (positions 7999 to 9750), and includes siRNA duplexes with alternate chemistries. Of the 3'UTR_AAV2 targeting siRNA duplexes (positions 7999 to 9750) evaluated in the in vivo screen shown in Table 12, 1 achieved ≥80% knockdown of SCN9A, 4 achieved ≥60% knockdown of SCN9A, 6 achieved ≥30% knockdown of SCN9A, and 7 achieved ≥20% knockdown of SCN9A.

TABLE 12

Efficacy and duration of exemplary distal 3'UTR targeting SCN9A siRNAs (positions 7999 to 9750) in mice

| Treatment* | SEQ ID NO Sense/Antisense | Chemistry | % Message Remaining at Day 14 post treatment | St. Dev. |
|---|---|---|---|---|
| PBS | | n/a | 100.00 | 9.16 |
| AAV-only | | | 109.27 | 7.75 |
| AD-64228.39 (TTR control) | | (AAV control) Fluoro | 64.03 | 9.62 |
| AD-802471.2 | 1819/1820 | N6-C16 + VP + Fluoro | 28.30 | 3.24 |
| AD-961342.2 | 2513/2603 | N6-C16 + VP + Non-Fluoro | 42.46 | 6.81 |
| AD-961334.2 | 5411/5427 | N6-C16 + VP + Non-Fluoro | 29.65 | 2.41 |
| AD-1010697.2 | 2519/2609 | N6-C16 + VP + Non-Fluoro | 84.05 | 13.41 |
| AD-1010698.2 | 2522/2612 | N6-C16 + VP + Non-Fluoro | 72.76 | 10.07 |
| AD-802123.2 | 1843/1844 | N6-C16 + VP + Fluoro | 36.01 | 1.91 |
| AD-801647.2 | 1851/1852 | N6-C16 + VP + Fluoro | 10.26 | 0.94 |
| AD-961163.2 | 5864/5953 | N6-C16 + VP + Fluoro + GNA | 61.24 | 15.34 |

(*the number following the decimal point in a duplex name merely refers to a batch production number)

Figure 1B:
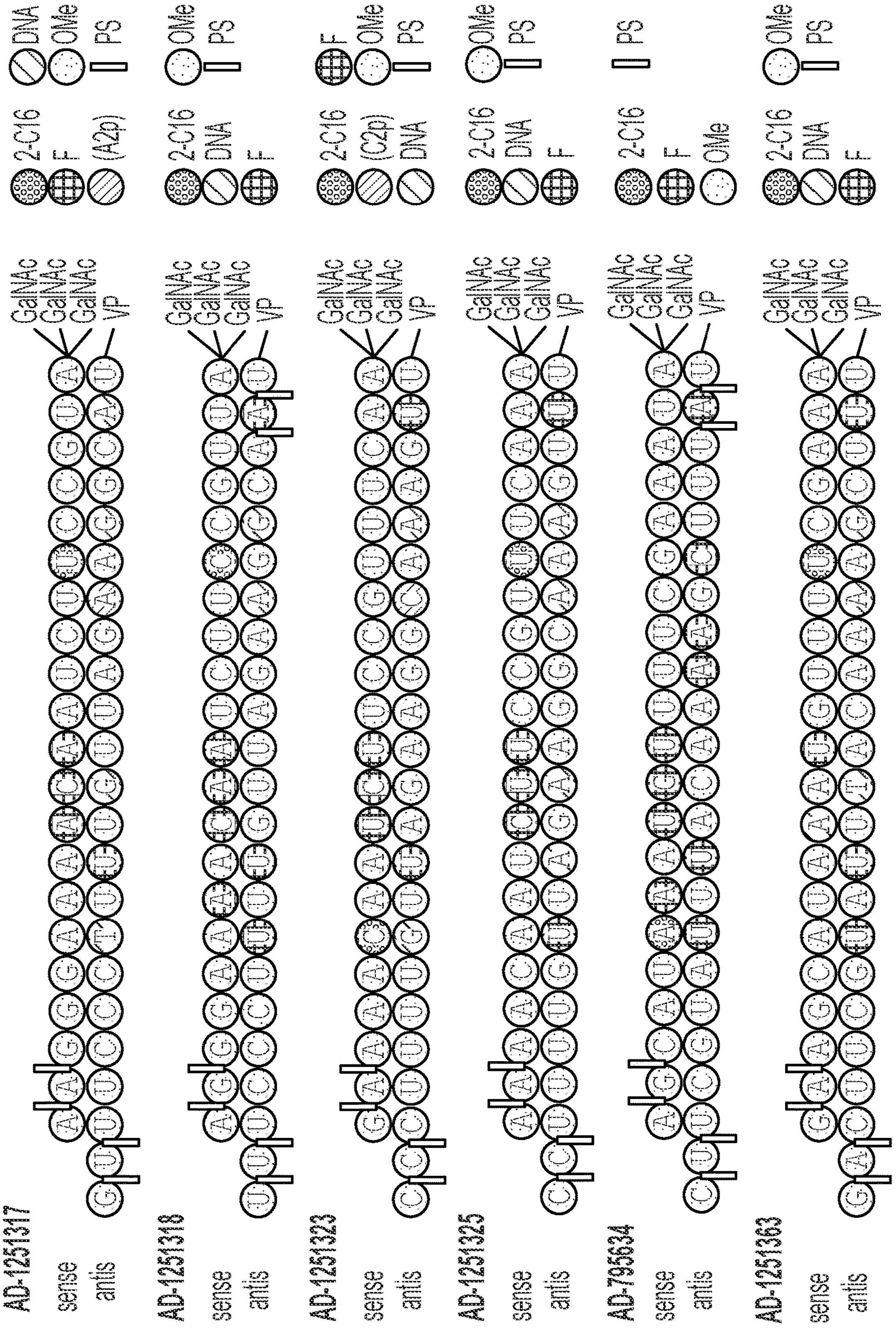
FIG. 1B depicts the sequences and chemistry of exemplary SCN9A siRNAs including AD-1251317, AD-1251318, AD-1251323, AD-1251325, AD-795634, AD-1251363.
Figure 1C:
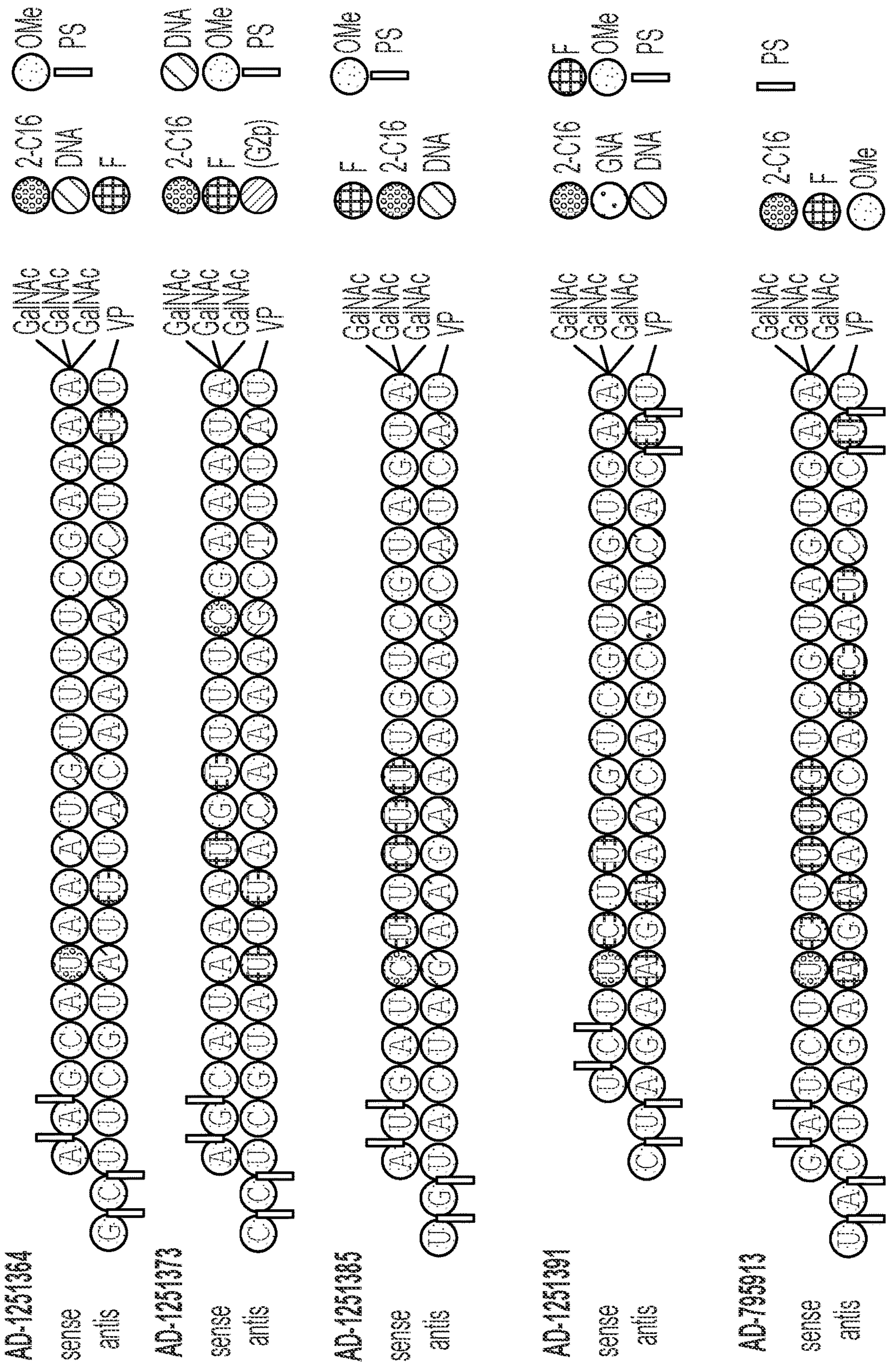
FIG. 1C depicts the sequences and chemistry of exemplary SCN9A siRNAs including AD-1251364, AD-1251373, AD-1251385, AD-1251391, and AD-795913. For each siRNA, "F" is the "2'-fluoro" modification, OMe is a methoxy group, GNA refers to a glycol nucleic acid, "(A2p)" refers to adenosine 2'-phosphate, "(C2p)" refers to cytosine 2'-phosphate, "(G2p)" refers to guanosine 2'-phosphate, "DNA" refers to a DNA base, 2-C16 refers to the targeting ligand, and PS refers to the phosphorothioate linkage.
Figure 2:
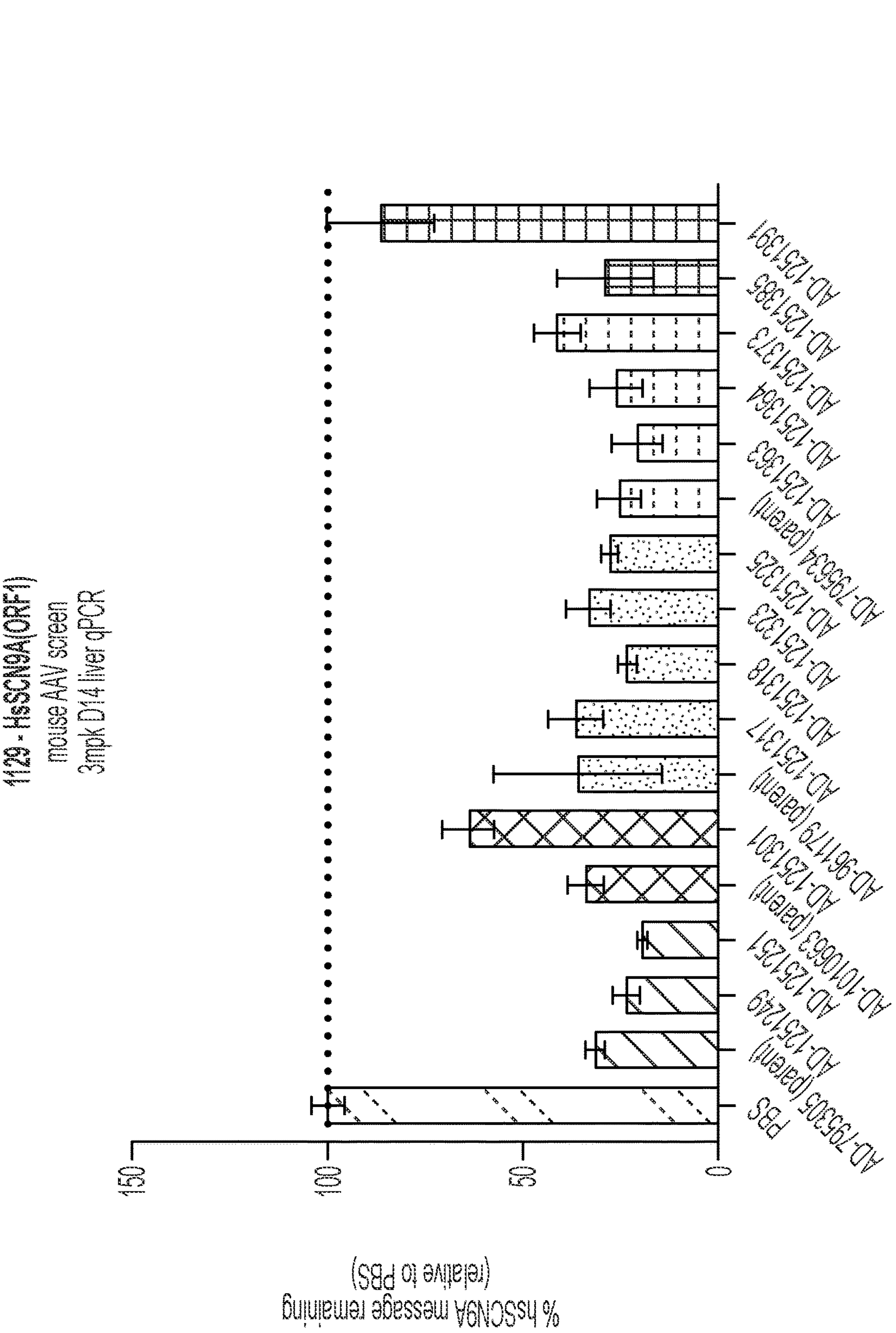
FIG. 2 is a graph depicting the percent SCN9A message remaining relative to PBS in mice on day 14 post-treatment with the exemplary duplexes indicated on the X-axis (from left to right: PBS, AD-795305 (parent), AD-1251249, AD-1251251, AD-1010663 (parent), AD-1251301, AD-961179 (parent), AD-1251317, AD-1251318, AD-1251323, AD-1251325, AD-795634 (parent), AD-1251363, AD-1251364, AD-1251373, AD-1251385, and AD-1251391).
Figure 3A:
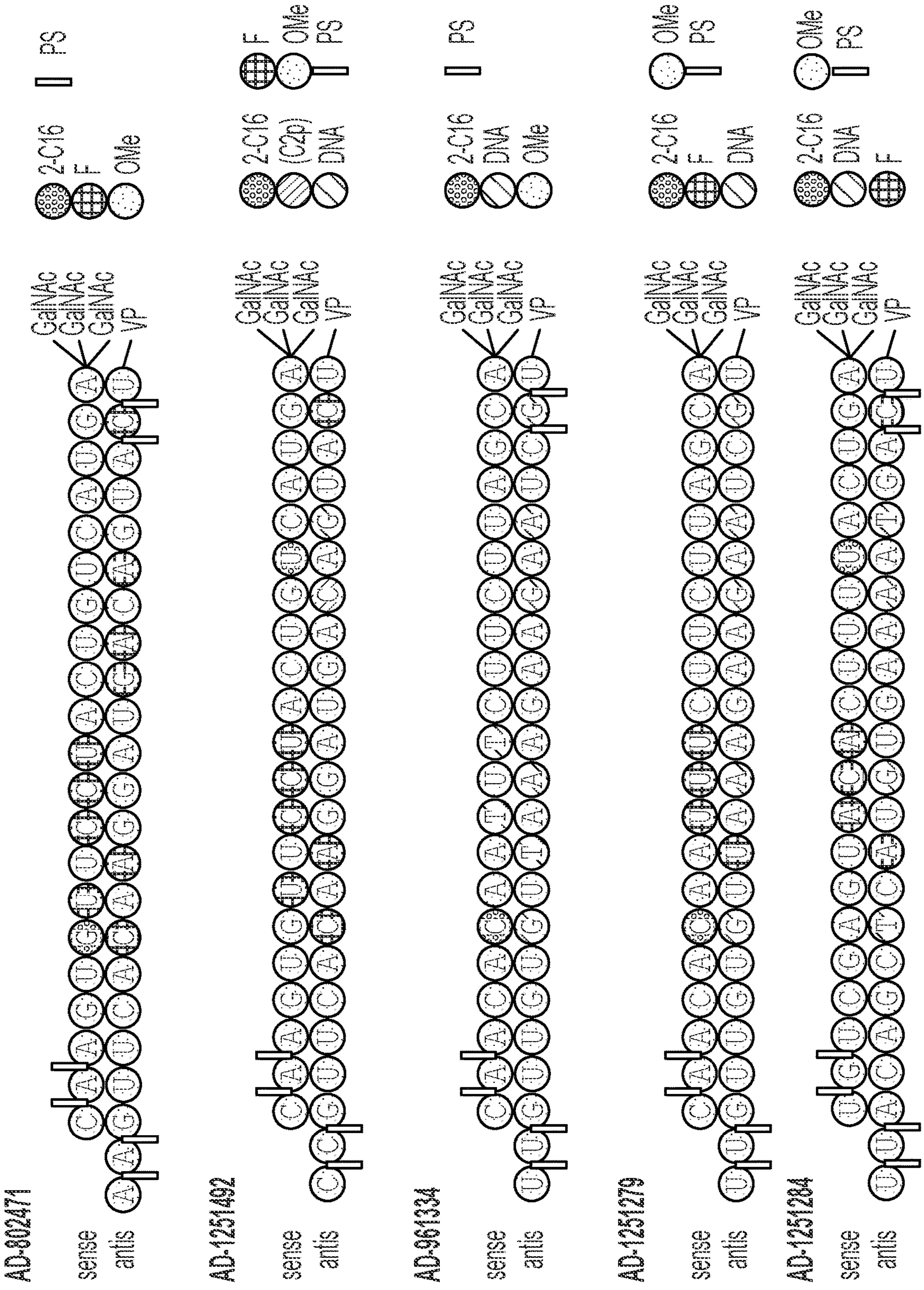
FIG. 3A depicts the sequences and chemistry of exemplary SCN9A siRNAs including AD-802471, AD-1251492, AD-961334, AD-1251279, and AD-1251284.
Figure 3B:
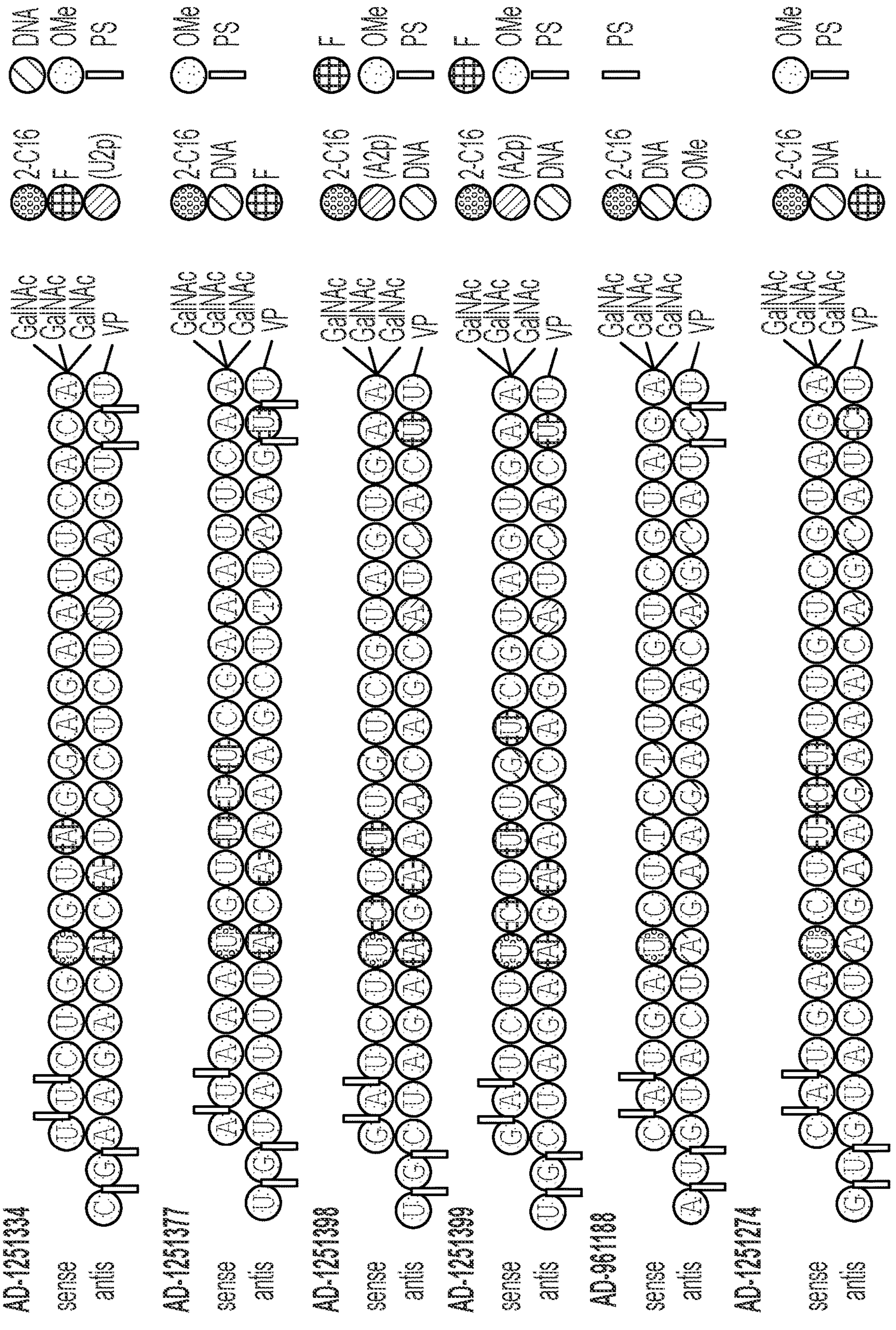
FIG. 3B depicts the sequences and chemistry of exemplary SCN9A siRNAs including AD-1251334, AD-1251377, AD-1251398, AD-1251399, AD-961188, and AD-1251274.
Figure 3C:
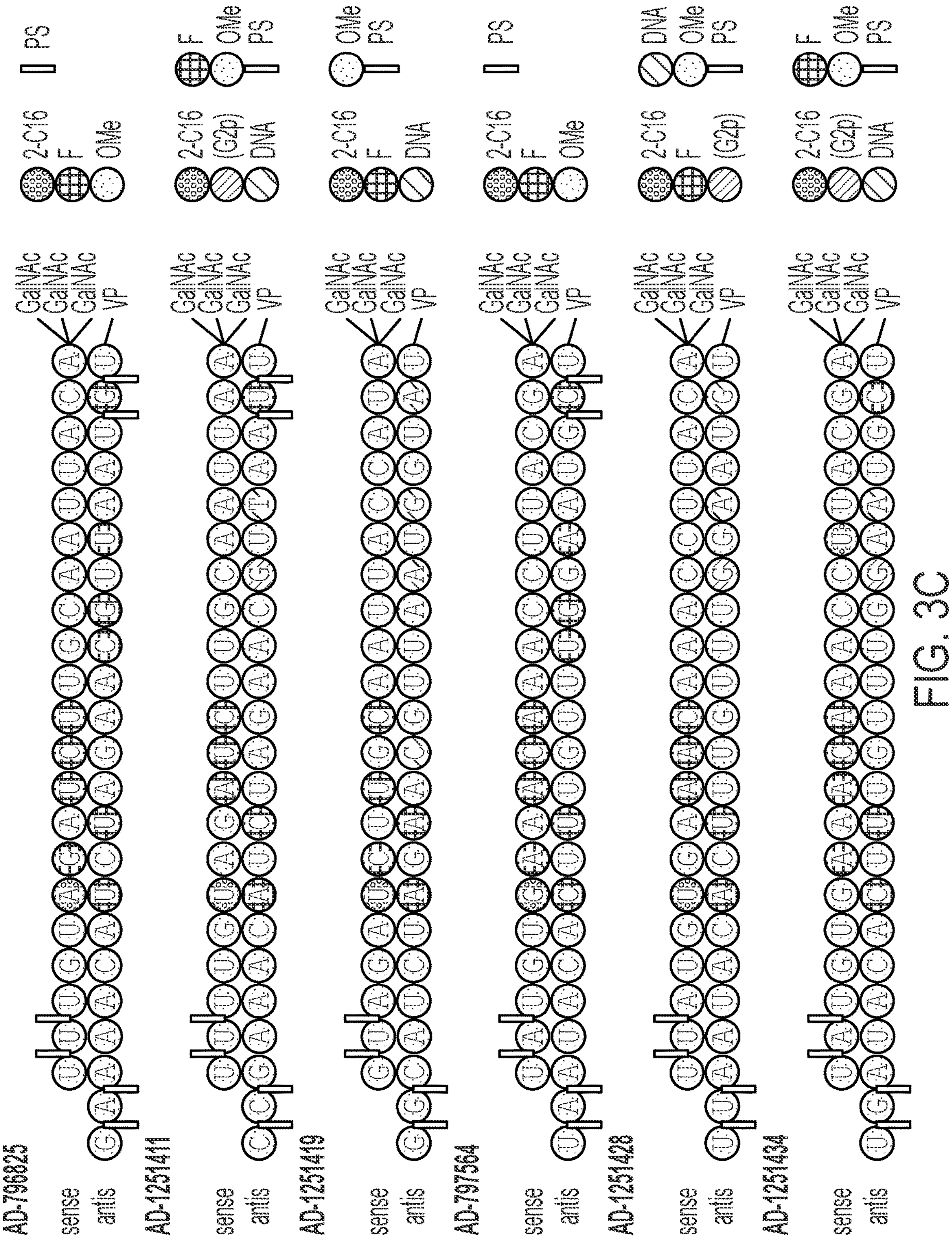
FIG. 3C depicts the sequences and chemistry of exemplary SCN9A siRNAs including AD-796825, AD-1251411, AD-1251419, AD-797564, AD-1251428, and AD-1251434.
Figure 3D:
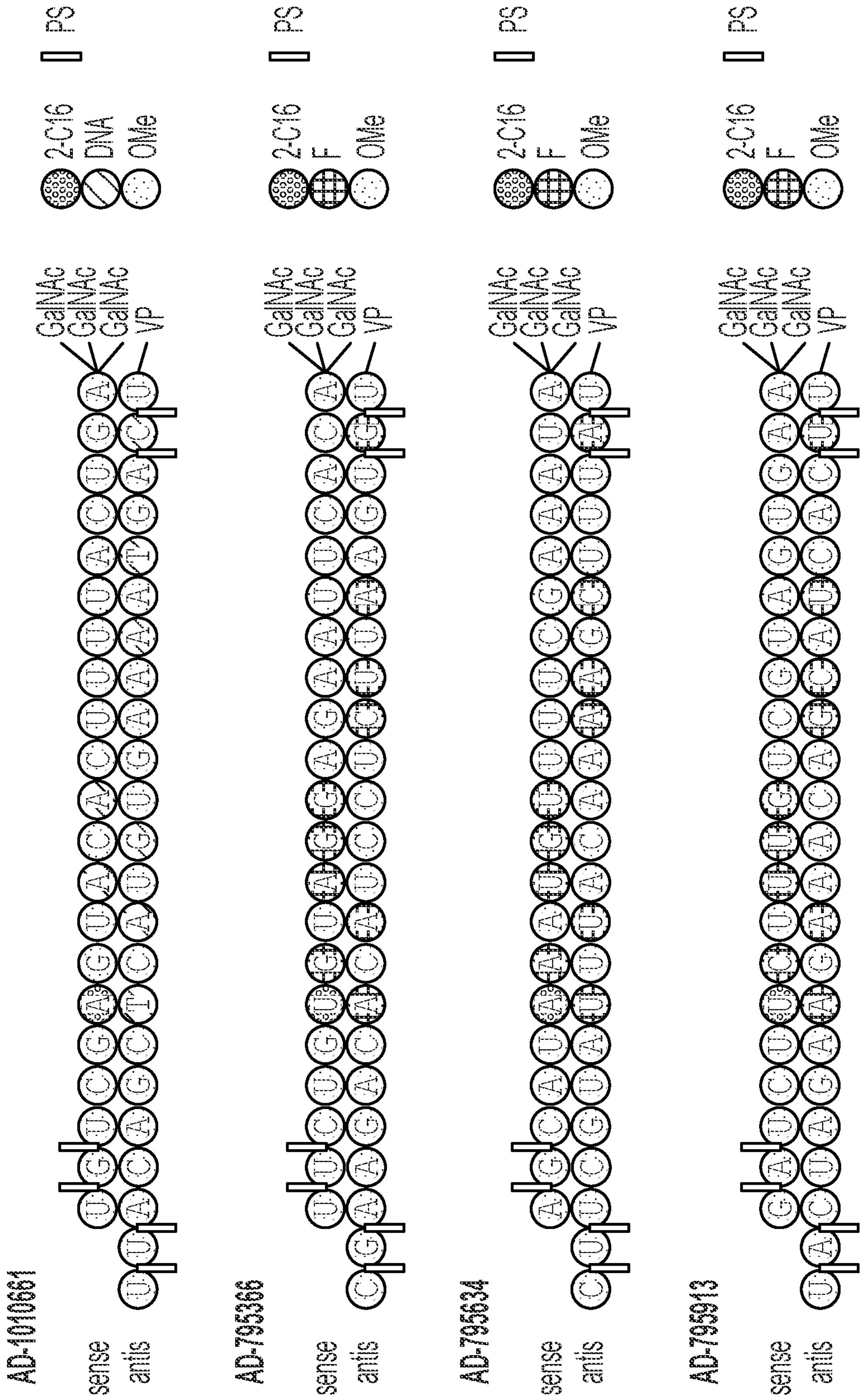
FIG. 3D depicts the sequences and chemistry of exemplary SCN9A siRNAs including AD-1010661, AD-795366, AD-795634, and AD-795913. For each siRNA, "F" is the "2'-fluoro" modification, OMe is a methoxy group, GNA refers to a glycol nucleic acid, "(A2p)" refers to adenosine 2'-phosphate, "(C2p)" refers to cytosine 2'-phosphate, "(U2p)" refers to uracil 2'-phosphate, "(G2p)" refers to guanosine 2'-phosphate, "DNA" refers to a DNA base, 2-C16 refers to the targeting ligand, and PS refers to the phosphorothioate linkage.

Table 19 and FIG. 2 (siRNA duplexes correspond to siRNA sequences in Table 18 and FIGS. 1A-1C) demonstrate the results of the in vivo screen for the ORF-1-targeting duplexes with the chemistries described in Table 18 and shown in FIGS. 1A-1C. Of the ORF-1 targeting duplexes evaluated in the in vivo screen shown in Table 19, 1 achieved ≥80% knockdown of SCN9A, 8 achieved ≥70% knockdown of SCN9A, 13 achieved ≥60% knockdown of SCN9A, 14 achieved ≥50% knockdown of SCN9A, and 15 achieved ≥30% knockdown of SCN9A. The results summarized in Table 19 also demonstrate that several modifications were tolerable in vivo with similar or improved potency compared to parent duplexes.

TABLE 19

Efficacy of exemplary SCN9A siRNA duplexes in mice. In this table, the column "Duplex Name" provides the numerical part of the duplex name without a suffix (e.g., number following the decimal point that can be included in a duplex name). The suffix merely refers to a batch production number. The suffix can be omitted from the duplex name without changing the chemical structure. For example, duplex AD-795305 in Table 19 refers to the same duplex as AD-795305.2 in Table 18.

| Duplex Name (Administered at 3 mg/kg) | SEQ ID NO Sense/Antisense | Day 14 post-treatment % SCN9A Message Remaining | StDev |
|---|---|---|---|
| PBS | | 100.00 | 4.16 |
| AD-795305 (parent) | 5330/5346 | 31.56 | 2.46 |
| AD-1251249 | 5331/5347 | 23.56 | 3.45 |
| AD-1251251 | 5332/5348 | 19.56 | 1.28 |
| AD-1010663 (parent) | 5333/5349 | 34.01 | 4.55 |
| AD-1251301 | 5334/5350 | 64.01 | 6.65 |
| AD-961179 (parent) | 5335/5351 | 35.99 | 21.51 |
| AD-1251317 | 5336/5352 | 36.50 | 6.98 |
| AD-1251318 | 5327/5353 | 23.35 | 2.38 |
| AD-1251323 | 5338/5354 | 33.32 | 5.62 |

TABLE 19-continued

Efficacy of exemplary SCN9A siRNA duplexes in mice. In this table, the column "Duplex Name" provides the numerical part of the duplex name without a suffix (e.g., number following the decimal point that can be included in a duplex name). The suffix merely refers to a batch production number. The suffix can be omitted from the duplex name without changing the chemical structure. For example, duplex AD-795305 in Table 19 refers to the same duplex as AD-795305.2 in Table 18.

| Duplex Name (Administered at 3 mg/kg) | SEQ ID NO Sense/Antisense | Day 14 post-treatment % SCN9A Message Remaining | StDev |
|---|---|---|---|
| AD-1251325 | 5339/5355 | 27.82 | 2.14 |
| AD-795634 (parent) | 5340/5356 | 25.39 | 5.54 |
| AD-1251363 | 5341/5357 | 20.81 | 6.51 |
| AD-1251364 | 5342/5358 | 26.37 | 6.88 |
| AD-1251373 | 5343/5359 | 41.23 | 5.94 |
| AD-1251385 | 5344/5360 | 29.05 | 12.32 |
| AD-1251391 | 5345/5361 | 86.58 | 13.78 |

Figure 4A:
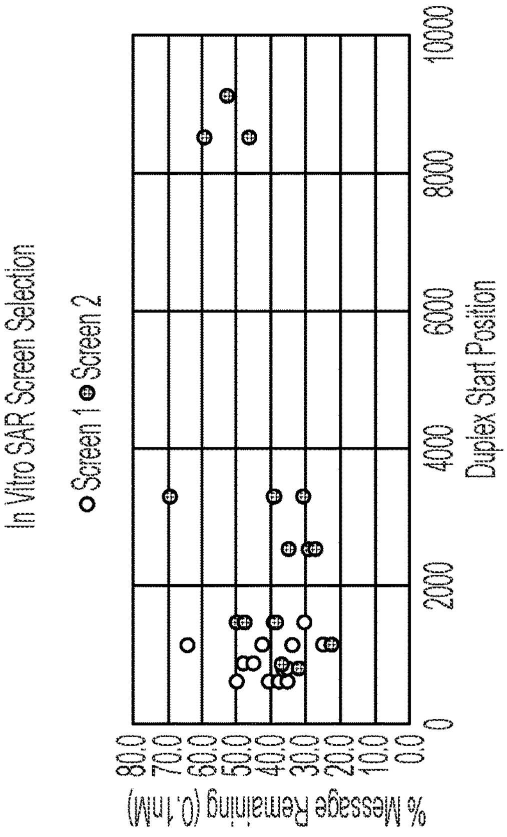
FIGS. 4A-4C present a series of graphs depicting the percent SCN9A message remaining versus the starting position in the target mRNA (NM_001365536.1) of the sense strand of the duplex grouped by those tested in screens 1 and 2 (targeting ORF-1, ORF-2, and the 3' UTR).
Figure 4B:
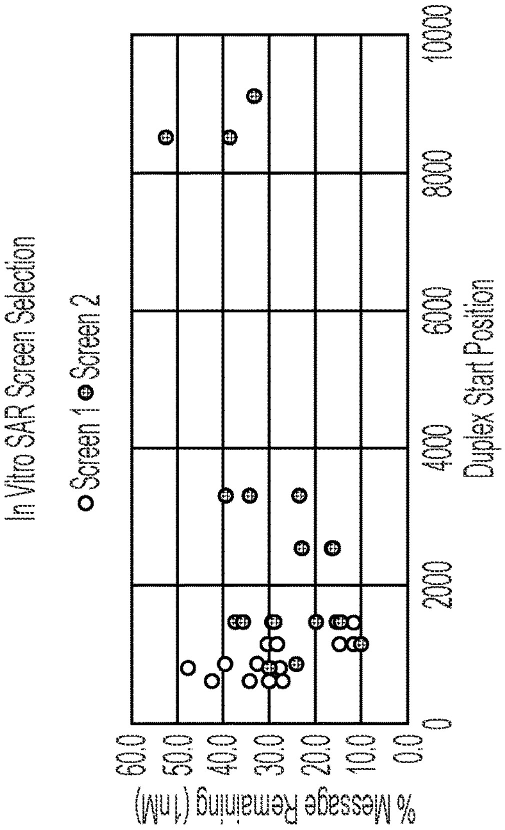
Figure 4C:
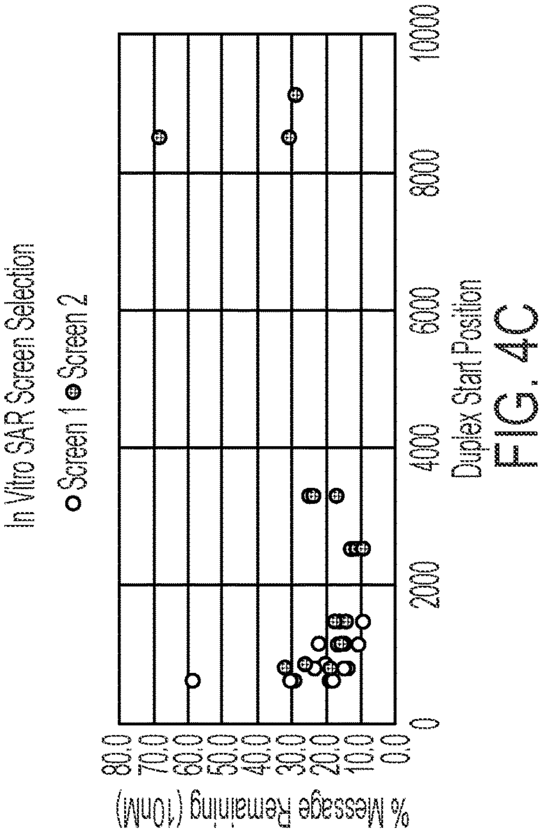

Following in vitro testing in Example 3 and the results in Table 17, a subset of duplexes were selected and placed in two groups: screen 1, which included AD-1010663.3, AD-1251301.1, AD-1251249.1, AD-1251251.1, AD-795305.3, AD-1251363.1, AD-1251364.1, AD-1251373.1, AD-795634.4, AD-1251385.1, AD-1251391.1, AD-1251317.1, AD-1251318.1, AD-1251323.1, AD-1251325.1, and AD-961179.3, screen 2 which included AD-1251492.1, AD-1251279.1, AD-961334.3, AD-1251284.1, AD-1251334.1, AD-1251377.1, AD-1251398.1, AD-1251399.1, AD-1251274.2, AD-961188.3, AD-1251411.1, AD-1251419.1, AD-796825, AD-1251428.1, AD-797564.4, and AD-1251434.1. The percent SCN9A message remaining when these duplexes were tested at a 0.1 nM (FIG. 4A), 1 nM (FIG. 4B), and 10 nM (FIG. 4C) was graphed versus the position in the target SCN9A mRNA of the sense strand of the tested duplex. From these graphs, a set of duplexes was selected for in vivo investigation, which are shown in Table 20 and FIGS. 3A-3D.

Figure 5:
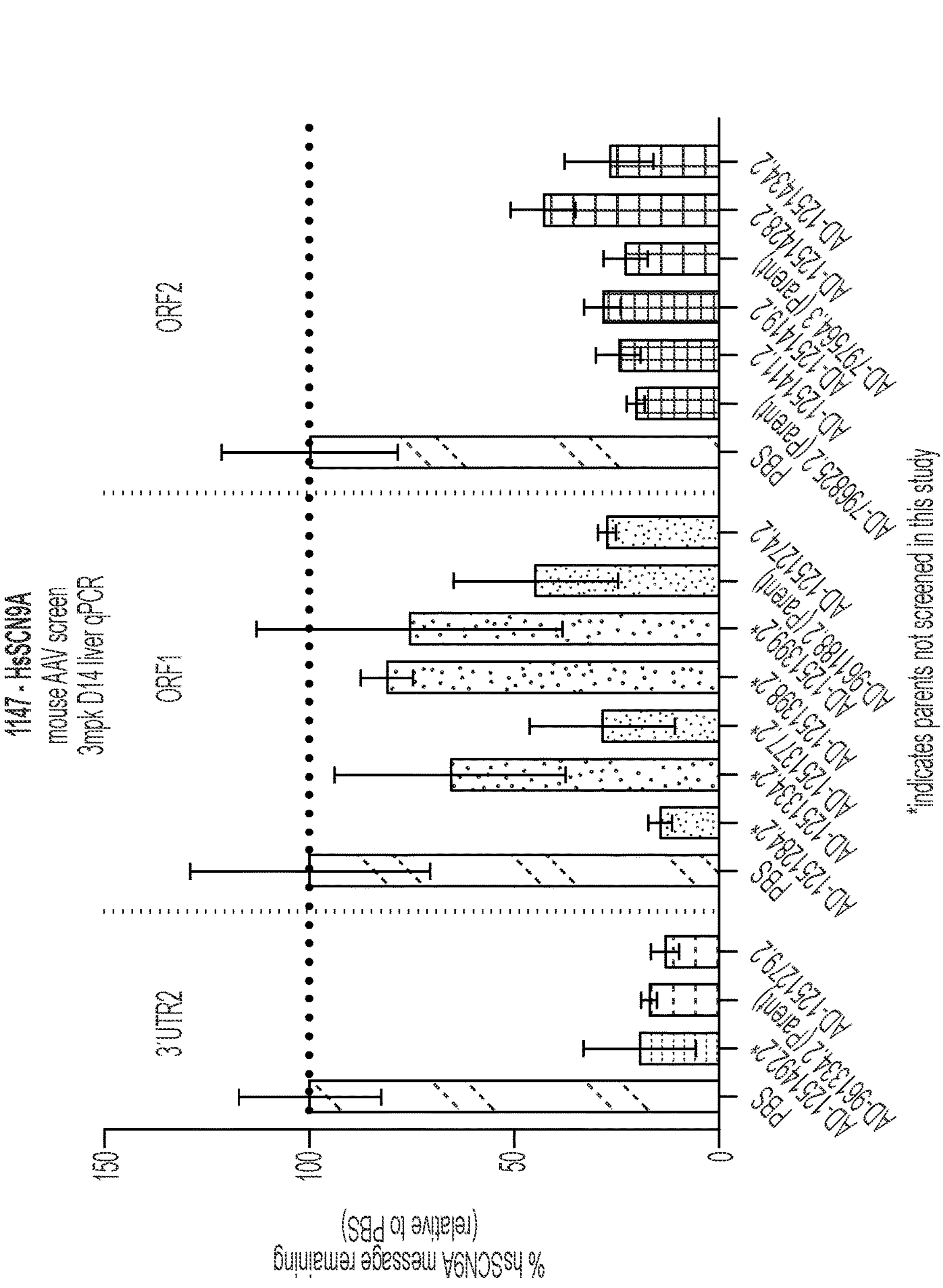
FIG. 5 is a graph depicting the percent SCN9A message remaining relative to PBS in mice on day 14 post-treatment with the exemplary duplexes indicated on the X-axis (from left to right: PBS, AD-1251492.2*, AD-961334.2 (parent), AD-1251279.2, PBS, AD-1251284.2*, AD-1251334.2*, AD-1251377.2*, AD-1251398.2*, AD-1251399.2*, AD-961188.2 (parent), AD-1251274.2, PBS, AD-796825.2 (parent), AD-1251411.2, AD-1251419.2, AD-797564.3 (parent), AD-1251428.2, and AD-1251434.2. The graph is divided into subsections for those duplexes that target the 3'UTR2 (AD-1251492.2*, AD-961334.2 (parent), AD-1251279.2), ORF1 (AD-1251284.2*, AD-1251334.2*, AD-1251377.2*, AD-1251398.2*, AD-1251399.2*, AD-961188.2 (parent), AD-1251274.2), and ORF2 (AD-796825.2 (parent), AD-1251411.2, AD-1251419.2, AD-797564.3 (parent), AD-1251428.2, AD-1251434.2).
Figure 6A:
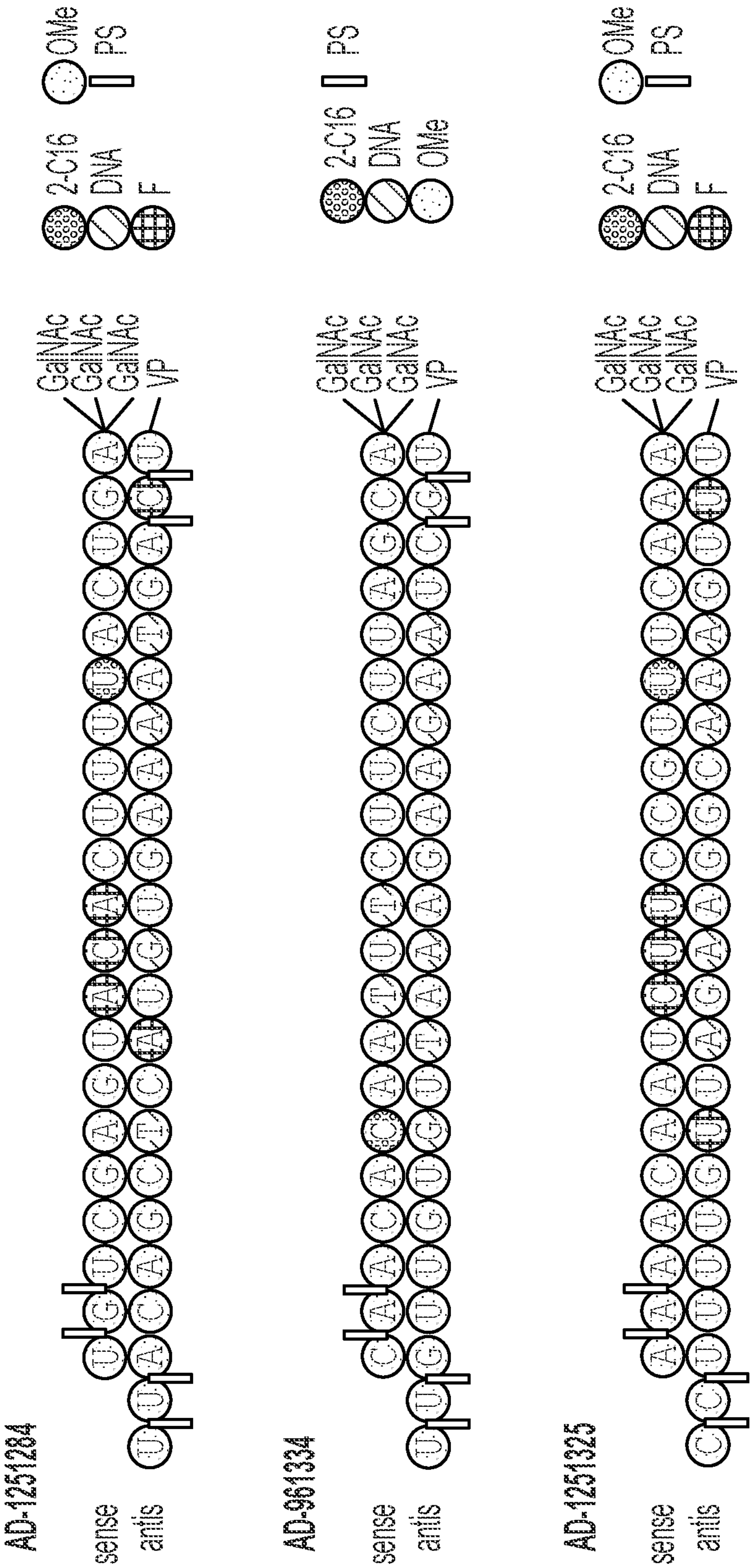
FIG. 6A depicts the sequences and chemistry of exemplary SCN9A siRNAs including AD-1251284, AD-961334, and AD-1251325.
Figure 6B:
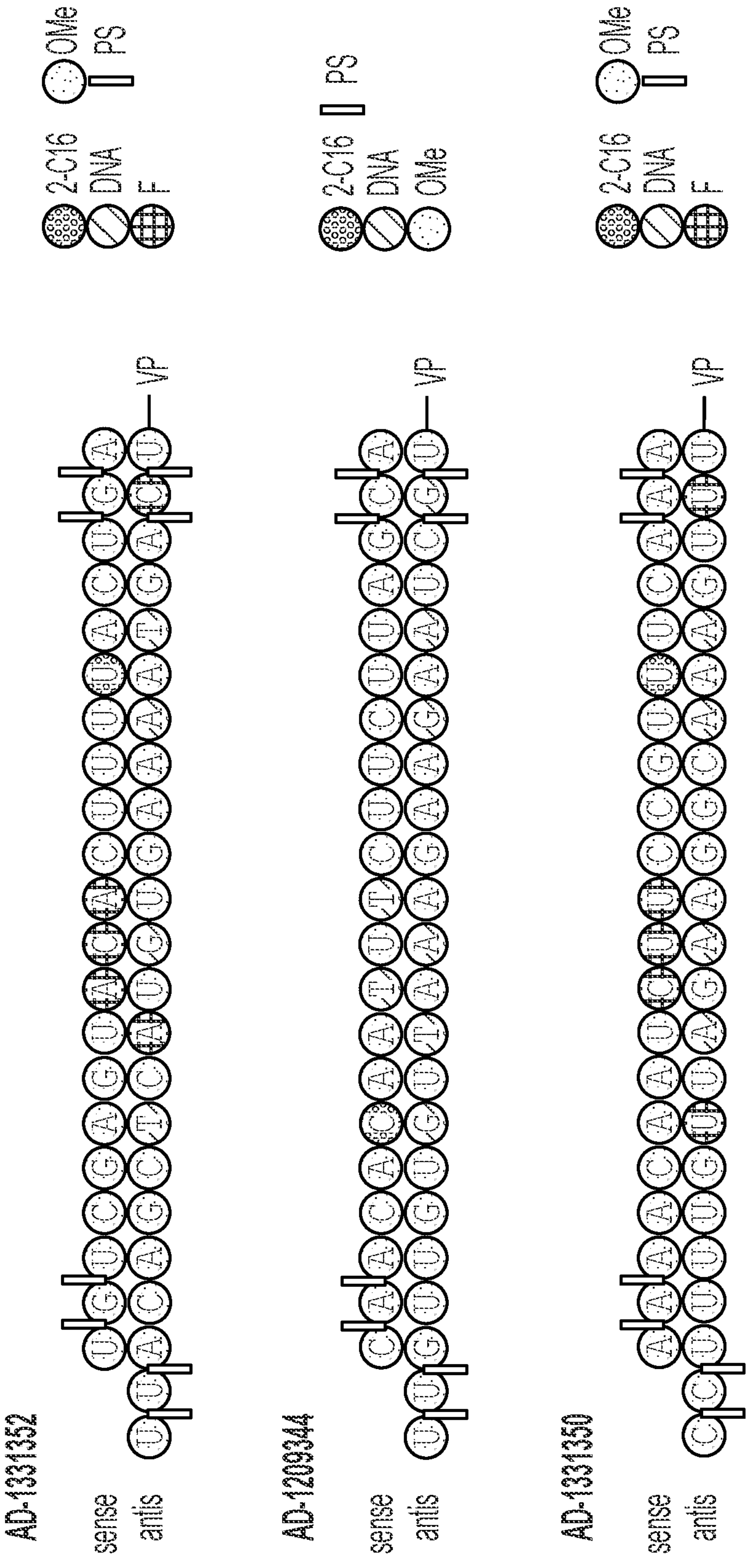
FIG. 6B depicts the sequences and CNS chemistry of exemplary SCN9A duplexes AD-1331352, AD-1209344, and AD-1331350.

Table 21 and FIG. 5 (siRNA duplexes correspond to siRNA sequences in Table 20 and FIGS. 3A-3D) demonstrate the results of the in vivo screen for the duplexes targeting region 2 of the 3' UTR of SCN9A (HsSCN9A_3 UTR2, e.g., positions 7999 to 9750), ORF-1 of SCN9A (HsSCN9A_ORF1rp, e.g., positions 299-2441), and ORF2 of SCN9A (HsSCN9A_ORF2rp, e.g., positions 2392-4345), with the chemistries described in Table 20 and shown in FIGS. 3A-3D. Of the exemplary duplexes investigated in the in vivo screen shown in Table 20, 4 achieved ≥80% knockdown of SCN9A, 11 achieved ≥70% knockdown of SCN9A, 13 achieved ≥50% knockdown of SCN9A, 14 achieved ≥30% knockdown of SCN9A, 15 achieved ≥20% knockdown of SCN9A, and 16 achieved ≥10% knockdown of SCN9A. The results summarized in Table 19 also demonstrate that several modifications were tolerable in vivo with similar potency compared to parent duplexes.

TABLE 21

Efficacy of exemplary SCN9A siRNA duplexes in mice. In this table, the exemplary duplexes investigated correspond to those summarized in Table 20 and FIGS. 3A-3D. The prior parent data corresponds to duplexes tested with data summarized in Tables 10-12. The column "Parent Duplex Name" provides the numerical part of the duplex name without a suffix (e.g., number following the decimal point that can be included in a duplex name). The suffix merely refers to a batch production number. The suffix can be omitted from the duplex name without changing the chemical structure. For example, duplex AD-802471 in Table 21 refers to the same duplex as AD-802471.2 in Table 12.

| | Exemplary Duplexes Investigated | | | Prior Parent Data (see, Tables 10-12) | | |
|---|---|---|---|---|---|---|
| | Duplex Name (Administered | Day 14 post-treatment | | Parent Duplex | Day 14 post-treatment | |
| AAV | at 3 mg/kg) (SEQ ID NO sense/antisense) | % SCN9A Message Remaining | StDev | Name (SEQ ID NO sense/antisense) | % SCN9A Message Remaining | StDev |
| 3UTR2 | PBS | 100.00 | 17.39 | | | |
| | AD-1251492.2* (5410/5426) | 19.42 | 13.58 | AD-802471 (1819/1820) | 28.30 | 3.24 |
| | AD-961334.2 (Parent) (5411/5427) | 17.15 | 1.96 | AD-961334 (self) (5411/5427) | 29.65 | 2.41 |
| | AD-1251279.2 (5412/5428) | 13.34 | 3.34 | AD-961334 (5411/5427) | 29.65 | 2.41 |
| ORF1rp | PBS | 100.00 | 29.22 | | | |
| | AD-1251284.2* (5413/5429) | 14.43 | 2.84 | AD-1010661 (4033/4299) | 41.08 | 6.19 |
| | AD-1251334.2* (5414/5430) | 65.74 | 28.11 | AD-795366 (4052/4318) | 29.15 | 4.74 |
| | AD-1251377.2* (5415/5431) | 28.53 | 17.61 | AD-795634 (5340/5356) | 20.80 | 6.50 |
| | AD-1251398.2* (5416/5432) | 81.26 | 6.35 | AD-795913 (4136/4402) | 26.74 | 5.61 |
| | AD-1251399.2* (5417/5433) | 75.63 | 37.43 | AD-795913 (4136/4402) | 26.74 | 5.61 |
| | AD-961188.2 (Parent) (5418/5434) | 44.91 | 20.18 | AD-961188 (self) (5418/5434) | 38.51 | 0.36 |
| | AD-1251274.2 (5419/5435) | 27.38 | 2.23 | AD-961188 (5418/5434) | 38.51 | 0.36 |
| ORF2rp | PBS | 100.00 | 21.48 | | | |
| | AD-796825.2 (Parent) (5420/5436 | 20.38 | 2.13 | AD-796825 Self) (5420/5436) | 12.49 | 2.90 |
| | AD-1251411.2 (5421/5437) | 24.57 | 5.44 | AD-796825 (5420/5436) | 12.49 | 2.90 |
| | AD-1251419.2 (5422/5438) | 28.49 | 4.48 | AD-796825 (5420/5436) | 12.49 | 2.90 |
| | AD-797564.3 (Parent) (5423/5439) | 22.90 | 5.49 | AD-797564 (self) (5423/5439) | 13.59 | 5.19 |
| | AD-1251428.2 (5424/5440) | 43.00 | 7.98 | AD-797564 (5423/5439) | 13.59 | 5.19 |
| | AD-1251434.2 (5425/5441) | 26.85 | 10.83 | AD-797564 (5423/5439) | 13.59 | 5.19 |

*parents not screened in this study

SEQUENCE LISTING (6083 sequences)

SEQ ID NO: 1 - RNA, 9766 nt, Homo sapiens
cggggcugcuaccuccacgggcgcgcccuggcaggaggggcgcagucugcuugcaggcggucgccagcgcuccagcggcggcugucggcuuuccaauuccgccagcucggcugaggcugggcuagccugggugccaguggcugcuagcggcaggcguccccugagcaacaggagcccagagaaaaagaagcagcccugagagagcgccggggaaggagaggcccgcgcccucuccuggagccagauucugcaggugcacuggguggggaugaucggcgggcuagguugcaagccucuuaugugaggagcugaagaggaauuaaaauauacaggaugaaaagauggcaauguugccucccccaggaccucagagcuuuguccauuucacaaaacagucucuugcccucauugaacaacgcauugcugaaagaaaaucaaaggaacccaaagaagaaaagaaagaugaugaugaagaagccccaaagccaagcagugacuuggaagcuggcaaacagcugcccuucaucuauggggacauuccucccggcauggugucagagccccuggaggacuuggaccccuacuaugcagacaaaaagacuuucauaguauugaacaaagggaaaacaaucuuccguuucaaugccacaccugcuuuauauaugcuuucuccuuucaguccucuaagaagaauaucuauuaagauuuuaguacacuccuuauucagcaugcucaucaugugcacuauucugacaaacugcauauuuaugaccaugaauaacccaccggacuggaccaaaaaugucgaguacacuuuuacuggaauauauacuuuugaaucacuuguaaaaauccuugcaagaggcuucuguguaggagaauucacuuuucuucgugacccguggaacuggcuggauuuugucgucauuguuuuugcguauuuaacagaauuuguaaaccuaggcaauguuucagcucuucgaacuuucagaguauugagagcuuugaaaacuauuucuguaaucccaggccugaagacaauuguaggggcuuugauccagucagugaagaagcuuucugaugucaugauccugacuguguucugucugaguguguuugcacuaauuggacuacagcuguucaugggaaaccugaagcauaaauguuuucgaaauucacuugaaaauaaugaaacauuagaaagcauaaugaauacccuagagagugaagaagacuuuagaaaauauuuuuauuacuuggaaggauccaaagaugcucuccuuugugguuucagcacagauucaggucaguguccagagggguacaccugugugaaaauuggcagaaacccugauuauggcuacacgagcuuugacacuuucagcugggccuucuuagccuuguuuaggcuaaugacccaagauuacugggaaaaccuuuaccaacagacgcugcgugcugcuggcaaaaccuacaugaucuucuuugucguagugauuuuccugggcuccuuuuaucuaauaaacuugauccuggcugugguugccauggcauaugaagaacagaaccaggcaaacauugaagaagcuaaacagaaagaauuagaauuucaacagauguuagaccgucuuaaaaaagagcaagaagaagcugaggcaauugcagcggcagcggcugaauauacaaguauuaggagaagcagaauuaugggccucucagagaguucuucugaaacauccaaacugagcucuaaaagugcuaaagaaagaagaaacagaagaaagaaaaagaaucaaaagaagcucuccaguggagaggaaaagggagaugcugagaaauugucgaaaucagaaucagaggacagcaucagaagaaaaaguuuccaccuuggugucgaagggcauaggcgagcacaugaaaagagguugucuacccccaaucagucaccacucagcauucguggcuccuuguuuucugcaaggcgaagcagcagaacaagucuuuuuaguuucaaaggcagaggaagagauauaggaucugagacugaauuugccgaugaugagcacagcauuuuuggagacaaugagagcagaaggggcucacuguuugugccccacagaccccaggagcgacgcagcaguaacaucagccaagccaguagguccccaccaaugcugccggugaacgggaaaaugcacagugcuguggacugcaacgguguggucucccugguugauggacgcucagcccucaugcuccccaauggacagcuucugccagagggcacgaccaaucaaauacacaagaaaaggcguuguaguuccuaucuccuuucagaggauaugcugaaugaucccaaccucagacagagagcaaugaguagagcaagcauauuaacaaacacuguggaagaacuugaagaguccagacaaaaauguccaccuuggugguacagauuugcacacaaauucuugaucuggaauugcucuccauauuggauaaaauucaaaaaguguaucuauuuuauuguaauggauccuuuuguagaucuugcaauuaccauuugcauaguuuuaaacacauuauuuauggcuauggaacaccacccaaugacugaggaauucaaaaauguacuugcuauaggaaauuuggucuuuacuggaaucuuugcagcugaaaugguauuaaaacugauugccauggauccauaugaguauuuccaaguaggcuggaauauuuuugacagccuuauugugacuuuaaguuuaguggagcucuuucuagcagauguggaaggauugucaguucugcgaucauucagacugcuccgagucuucaaguuggcaaaauccuggccaacauugaacaugcugauuaagaucauugguaacucaguaggggcucuagguaaccucaccuuaguguuggccaucaucgucuucauuuuugcuguggucggcaugcagcucuuugguaagagcuacaaagaaugugucugcaagaucaaugaugacuguacgcucccacgguggcacaugaacgacuucuuccacuccuuccugauuguguuccgcgugcuguguggagaguggauagagaccaugugggacuguauggaggucgcuggucaagcuaugugccuuauuguuuacaugauggucauggucauuggaaaccuggugguccuaaaccuauuucuggccuuauuauugagcucauuuaguucagacaaucuuacagcaauugaagaagacccugaugcaaacaaccuccagauugcagugacuagaauuaaaaagggaauaaauuaugugaaacaaaccuuacgugaauuuauucuaaaagcauuuuccaaaaagccaaagauuuccagggagauaagacaagcagaagaucugaauacuaagaaggaaaacuauauuucuaaccauacacuugcugaaaugagcaaaggucacaauuuccucaaggaaaaagauaaaaucagugguuuuggaagcagcguggacaaacacuugauggaagacagugauggucaaucauuuauucacaaucccagccucacagugacagugccaauugcaccuggggaauccgauuuggaaaauaugaaugcugaggaacuuagcagugauucggauagugaauacagcaaagugagauuaaaccggucaagcuccucagagugcagcacaguugauaacccuuugccuggagaaggagaagaagcagaggcugaaccuaugaauuccgaugagccagaggccuguuucacagaugguuguguacggagguucucaugcugccaaguuaacauagagucagggaaaggaaaaaucugguggaacaucaggaaaaccugcuacaagauuguugaacacaguugguuugaaagcuucauuguccucaugauccugcucagcaguggugcccuggcuuuugaagauauuuauauugaaaggaaaaagaccauuaagauuauccuggaguaugcagacaagaucuucacuuacaucuucauucuggaaaugcuucuaaaauggauagcauaugguuauaaaacauauuucaccaaugccugguguuggcuggauuuccuaauuguugauguuucuuugguuacuuuaguggcaaacacucuuggcuacucagaucuuggccccauuaaaucccuucggacacugagagcuuuaagaccucuaagagccuuaucuagauuugaaggaaugagggucguugugaaugcacucauaggagcaauuccuuccaucaugaaugugcuacuugugugucuuauauucuggcugauauucagcaucaugggaguaaauuuguuugcuggcaaguucuaugaguguauuaacaccacagaugggucacgguuuccugcaagucaaguuccaaaucguuccgaauguuuugcccuuaugaauguuagucaaaaugugcgauggaaaaaccugaaagugaacuuugauaaugucggacuugguuaccuaucucugcuucaaguugcaacuuuuaagggauggacgauuauuauguaugcagcaguggauucuguuaauguagacaagcagcccaaauaugaauauagccucuacauguauauuuauuuugucgucuuuaucaucuuugggucauucuucacuuugaacuuguucauuggugucaucauagauaauuucaaccaacagaaaaagaagcuuggaggucaagacaucuuuaugacagaagaacagaagaaauacuauaaugcaaugaaaaagcugggguccaagaagccacaaaagccaauuccucgaccagggaacaaaauccaaggauguauauuugaccuagugacaaaucaagccuuugauauuaguaucaugguucuuaucugucucaacaugguaaccaugaugguagaaaaggagggucaaagucaacauaugacugaaguuuuauauuggauaaaugugguuuuuauaauccuuuucacuggagaaugugugcuaaaacugaucucccucagacacuacuacuucacuguaggauggaauauuuuugauuuugugguugugauuaucuccauuguagguauguuucuagcugauuugauugaaacguauuuuguguccccuacccuguuccgagugauccgucuugccaggauuggccgaauccuacgucuagucaaaggagcaaaggggauccgcacgcugcucuuugcuuugaugaugucccuuccugcguuguuuaacaucggccuccugcucuuccuggucauguucaucuacgccaucuuuggaauguccaacuuugccuauguuaaaaaggaagauggaauuaaugacauguucaauuuugagaccuuuggcaacaguaugauuugccuguuccaaauuacaaccucugcuggcugggauggauugcuagcaccuauucuuaacaguaagccacccgacugugacccaaaaaaaguucauccuggaaguucaguugaaggagacugugguaacccaucuguuggaauauucuacuuuguuaguuauaucaucauauccuuccugguuguggugaacauguacauugcagucauacuggagaauuuuaguguugccacugaagaaaguacugaaccucugagugaggaugacuuugagauguucuaugagguuugggagaaguuugaucccgaugcgacccaguuuauagaguucucuaaacucucugauuuugcagcugcccuggauccuccucuucucauagcaaaacccaacaaaguccagcucauugccauggaucugcccaugguuaguggugaccggauccauugucuugacaucuuauuugcuuuuacaaagcguguuuugggugagaguggggagauggauucucuucguucacagauggaagaaagguucaugucugcaaauccuuccaaaguguccuaugaacccaucacaaccacacuaaaacggaaacaagaggaugugucugcuacugucauucagcgugcuuauagacguuaccgcuuaaggcaaaaugucaaaaauauaucaaguauauacauaaaagauggagacagagaugaugauuuacucaauaaaaaagauauggcuuuugauaauguuaaugagaacucaaguccagaaaaaacagaugccacuucauccaccaccucuccaccuucauaugauaacaaagccagacaaagagaaauaugaacaagacagaacagaaaaggaagacaaagggaaagacagcaaggaaagcaaaaaauagagcuucauuuuugauauauuguuuacagccugugaaagugauuuauuuguguuaauaaaacucuuuugaggaagucuaugccaaaauccuuuuuaucaaaauauucucgaaggcagugcagucacuaacucugauuuccuaagaaaggugggcagcauuagcagaugguuauuuuugcacugaugauucuuuaagaaucguaagagaacucuguaggaauuauugauuauagcauacaaaagugauucaguuuuuugguuuuuaauaaaucagaagaccauguagaaaacuuuuacaucugccuugucaucuuuucacaggauuguaauuagucuuguuucccauguaaauaaacaacacacgcauacagaaaaaucuauuauuuaucuauuauuuggaaaucaacaaaaguauuugccuuggcuuugcaaugaaaugcuugauagaaguaauggacauuaguuaugaauguuuaguuaaaaugcauuauuagggagcuugacuuuuuaucaauguacagagguuauucuauauuuugaggugcuuaaauuuauucuacauugcaucagaaccaauuuauaugugccuauaaaaugccaugggauuaaaaauauauguaggcuauucauuucuacaaauguuuuucauucaucuugacucacaugccaacaaggauaagacuuaccuuuagaguauuguguuucauagccuuucuucuuucauaucccuuuuuguucauagaauaaccacagaacuugaaaaauuauucuaaguacauauuacacuccucaaaaaaaacaaagauaacugagaaaaaaguuauugacagaaguucuauuugcuauuauuuacauagccuaacauuugacugugcugcccaaaauacugauaauagucucuuaaacucuuuugucaaauuuuccugcuuucuuaugcaguauuguuuagucauccuuucgcuguaagcaaaguugaugaaauccuuccugauaugcaguuaguuguuugaccacgguacauacuugagcagauaauaacuugggcacaguauuuauugcaucacuuguauacaaucccguguuuggcaagcuuucaaaucauguaauaugacagacuuuacacagauauguguuuaguaugaauaaaaaagcauugaaauagggauucuugccaacuugcucucuugccaccaacuuacuuuccuaaauuauggaaguaaucuuuuuuggauauacuucaauguauacaaugaggaagaugucaccuucuccuuaaaauucuaugaugugaaauauauuuugccucaaucaacacaguaccaugggcuucuaauuuaucaagcacauauucauuuugcauuagcuguagacaucuaguuuuuugaaaacaccuauuaauaguaauuugaaaagaaauaaccauaaugcuuuuuuucgugaguuuauuucaggaauaugagaucuuucuucuauaaaguuauucaugcacaggcaaaaauugagcuacacagguagaauguaguuuuacuuagaagauuuuugugggagguuuugaagcaaauauauaaaacaacuuucacuaauuugcuuuccauauuuaaaaaauaauaaauuacauuuauauaauaaauguuuaaagcacauauuuuuuguuguucuggcaauuuaaaaagaaagaggauuuaaacguaccuauagaaacaaagauuuaugguuaaagaaugagaucagaagucuagaauguuuuuaaauugugauauauuuuacaacauccguuauuacuuugagacauuuguccuaaucuacguauaaaacucaaucuagggcuaaagauucuuuauaccaucuuagguucauucaucuuaggcuauuugaaccacuuuuuaauuuaauaugaaagacaccaugcaguguuuuccgagacuacauagaucauuuuaucacauaccuaccaagccuguuggaaauagguuuugauaauuuaaguagggaccuauacaaaauauauuacauuuaucagauuuuuaaauacauucaauuaagaauuuaacaucaccuuaaauuugaauucaaucuaccguuauuucaaacucacaaauauaacugcauuaugaauacuuacauaauguaguaagacaagauguuugacagguucguguguaauuuucuauuaauguuuuuacauugccuuguuuuuauguaaaauaaaaaauaugggcaacugguuuguuaacaacacaauuucuucuuagcauuucaaaaauauauauaaaguuguucuuuuuccuauuucaugaacuauguuuuuuuuuaaaauaacaugguuaaguuuuauauauauuuacguuuguuucaggaaugucuacuugugacuuuuuaucaauuaaaaauaauauuuggaagaaagagcuuauuaaguauaagcuugaaguaaaauuagaccucucuuuccauguagauuacuguuuguacugaugguuucacccuucagaaggcacugucauauuaauauuuaaauuuuauaaucgcugaacuuauuacacccaacaauacagaaaggcaguuacacugaagaacuuaacuuagaauaaaauggaagcaaacagguuuucuaaaaacuuuuuuaagugaccaggucucgcucugucacccaggcuagagugcaauggcaugaucauagcucucugcagccucaacucugggcucaagcaacccuccugccucagccucccaaguagcuaagacuacagguacaugccaccaugccuggcuaauauuuaaauuuuuguagauaaggggucuugcuauguugcccaggcuagucucaaacuccuggcuucaaguguuccuacugucaugaccugccaacaugcugggguuacaggcaugagccaccaugccccaaacagguuugaacacaaaucuuucggaugaaaauuagagaaccuaauuuuagcuuuuugauaguuaccuaguuugcaaaagauuugggugacuugugagcuguuuuuaaaugcugauuguugaacaucacaacccaaaauacuuagcaugauuuuauagaguuuugauagcuuuauuaaaaagagugaaaauaaaaugcauauguaaauaaagcaguucuaaauagcuauuucagagaaauguuaauagaagugcugaaagaagggccaacuaaauuaggauggccagggaauuggccuggguuuaggaccuauguaugaaggccaccaauuuuuuaaaaauaucugugguuuauuauguuauuaucuucuugaggaaaacaaucaagaauugcuucaugaaaauaaauaaauagccaugaauaucauaaagcuguuuacauaggauucuuuacaaauuucauagaucuaugaaugcucaaaauguuugaguuugccauaaauuauauuguaguuauauuguaguuauacuugagacugacacauuguaauauaaucuaagaauaaaaguuauacaaaauaaaaaaaaaaaaa

SEQ ID NO: 2 - RNA, 9771 nt, Homo sapiens
uuuuuuuuuuuuuauuuuguauaacuuuuauucuuagauuauauuacaaugugucagucucaaguauaacuacaauauaacuacaauauaauuuauggcaaacucaaacauuuugagcauucauagaucuaugaaauuuguaaagaauccuauguaaacagcuuuaugauauucauggcuauuuauuuauuuucaugaagcaauucuugauuguuuuccucaagaagauaauaacauaauaaaccacagauauuuuuaaaaaauugguggccuucauacauagguccuaaacccaggccaauucccuggccauccuaauuuaguuggcccuucuuucagcacuucuauuaacauuucucugaaauagcuauuuagaacugcuuuauuuacauaugcauuuuauuuucacucuuuuuaauaaagcuaucaaaacucuauaaaaucaugcuaaguauuuuggguugugauguucaacaaucagcauuuaaaaacagcucacaagucacccaaaucuuuugcaaacuagguaacuaucaaaaagcuaaaauuagguucucuaauuuucauccgaaagauuuguguucaaaccuguuuggggcaugguggcucaugccuguaaccccagcauguuggcaggucaugacaguaggaacacuugaagccaggaguuugagacuagccugggcaacauagcaagaccccuuaucuacaaaaauuuaaauauuagccaggcaugguggcauguaccuguagucuuagcuacuugggaggcugaggcaggaggguugcuugagcccagaguugaggcugcagagagcuaugaucaugccauugcacucuagccugggugacagagcgagaccuggucacuuaaaaaaguuuuuagaaaaccuguuugcuuccauuuuauucuaaguuaaguucuucaguguaacugccuuucuguauuguuggguguaauaaguucagcgauuauaaaauuuaaauauuaauaugacagugccuucugaagggugaaaccaucaguacaaacaguaaucuacauggaaagagaggucuaauuuuacuucaagcuuauacuuaauaagcucuuucuuccaaauauuauuuuuaauugauaaaaagucacaaguagacauuccugaaacaaacguaaauauauauaaaacuuaaccauguuauuuuaaaaaaaaacauaguucaugaaauaggaaaaagaacaacuuuauauauauuuuugaaaugcuaagaagaaauuguguuguuaacaaaccaguugcccauauuuuuuauuuuacauaaaaacaaggcaauguaaaaacauuaauagaaaauuacacacgaaccugucaaacaucuugucuuacuacauuauguaaguauucauaaugcaguuauauuugugaguuugaaauaacgguagauugaauucaaauuuaaggugauguuaaauucuuaauugaauguauuuaaaaaucugauaaauguaauauauuuuguauaggucccuacuuaaauuaucaaaaccuauuuccaacaggcuugguagguaugugauaaaaugaucuauguagucucggaaaacacugcauggugucuuucauauuaaauuaaaaagugguucaaauagccuaagaugaaugaaccuaagaugguauaaagaaucuuuagcccuagauugaguuuuauacguagauuaggacaaaugucucaaaguaauaacggauguuguaaaauauaucacaauuuaaaaacauucuagacuucugaucucauucuuuaaccauaaaucuuuguuucuauagguacguuuaaauccucuuucuuuuuaaauugccagaacaacaaaaaauaugugcuuuaaacauuuauuauauaaauguaauuuauuauuuuuuaaauauggaaagcaaauuagugaaaguuguuuuauauauuugcuucaaaaccucccacaaaaaucuucuaaguaaaacuacauucuaccuguguagcucaauuuuugccugugcaugaauaacuuuauagaagaaagaucucauauuccugaaauaaacucacgaaaaaaagcauuaugguuauuucuuuucaaauuacuauuaauagguguuuucaaaaaacuagaugucuacagcuaaugcaaaaugaauaugugcuugauaaauuagaagcccaugguacuguguugauugaggcaaaauauauuucacaucauagaauuuuaaggagaaggugacaucuuccucauuguauacauugaaguauauccaaaaaagauuacuuccauaauuuaggaaaguaaguugguggcaagagagcaaguuggcaagaaucccuauuucaaugcuuuuuuauucauacuaaacacauaucuguguaaagucugucauauuacaugauuugaaagcuugccaaacacgggauuguauacaagugaugcaauaaauacugugcccaaguuauuaucugcucaaguauguaccguggucaaacaacuaacugcauaucaggaaggauuucaucaacuuugcuuacagcgaaaggaugacuaaacaauacugcauaagaaagcaggaaaauuugacaaaagaguuuaagagacuauuaucaguauuuugggcagcacagucaaauguuaggcuauguaaauaauagcaaauagaacuucugucaauaacuuuuuucucaguuaucuuuguuuuuuuugaggaguguaauauguacuuagaauaauuuuucaaguucugugguuauucuaugaacaaaaagggauaugaaagaagaaaggcuaugaaacacaauacucuaaagguaagucuuauccuuguuggcaugugagucaagaugaaugaaaaacauuuguagaaaugaauagccuacauauauuuuuaaucccauggcauuuuauaggcacauauaaauugguucugaugcaauguagaauaaauuuaagcaccucaaaauauagaauaaccucuguacauugauaaaaagucaagcucccuaauaaugcauuuuaacuaaacauucauaacuaauguccauuacuucuaucaagcauuucauugcaaagccaaggcaaauacuuuuguugauuuccaaauaauagauaaauaauagauuuuucuguaugcguguguuguuuauuuacaugggaaacaagacuaauuacaauccugugaaaagaugacaaggcagauguaaaaguuuucuacauggucuucugauuuauuaaaaaccaaaaaacugaaucacuuuuguaugcuauaaucaauaauuccuacagaguucucuuacgauucuuaaagaaucaucagugcaaaaauaaccaucugcuaaugcugcccaccuuucuuaggaaaucagaguuagugacugcacugccuucgagaauauuuugauaaaaaggauuuuggcauagacuuccucaaaagaguuuuauuaacacaaauaaaucacuuucacaggcuguaaacaauauaucaaaaaugaagcucuauuuuuugcuuuccuugcugucuuucccuuugucuuccuuuucuguucugucuuguucauauuucucuuugucuggcuuuguuacacuaucauaugaagguggagaggugguggaugaaguggcaucuguuuuuucuggacuugaguucucauuaacauuaucaaaagccauaucuuuuuuauugaguaaaucaucaucucugucuccaucuuuuauguauauacuugauauauuuuugacauuuugccuuaagcgguaacgucuauaagcacgcugaaugacaguagcagacacauccucuuguuuccguuuuagugugguugugauggguucauaggacacuuuggaaggauuugcagacaugaaccuuucuuccaucugugaacgaagagaauccaucuccccacucucacccaaaacacgcuuuguaaaagcaaauaagaugucaagacaauggauccggucaccacuaaccaugggcagauccauggcaaugagcuggacuuuguuggguuuugcuaugagaagaggaggauccagggcagcugcaaaaucagagaguuuagagaacucuauaaacugggucgcaucgggaucaaacuucucccaaaccucauagaacaucucaaagucauccucacucagagguucaguacuuucuucaguggcaacacuaaaauucuccaguaugacugcaauguacauguucaccacaaccaggaaggauaugaugauauaacuaacaaaguagaauauuccaacagauggguuaccacagucuccuucaacugaacuuccaggaugaacuuuuuuugggucacagucggguggcuuacuguuaagaauaggugcuagcaauccaucccagccagcagagguuguaauuuggaacaggcaaaucauacuguugccaaaggucucaaaauugaacaugucauuaauuccaucuuccuuuuuaacauaggcaaaguuggacauuccaaagauggcguagaugaacaugaccaggaagagcaggaggccgauguuaaacaacgcaggaagggacaucaucaaagcaaagagcagcgugcggauccccuuugcuccuuugacuagacguaggauucggccaauccuggcaagacggaucacucggaacaggguaggggacacaaaauacguuucaaucaaaucagcuagaaacauaccuacaauggagauaaucacaaccacaaaaucaaaaauauuccauccuacagugaaguaguagugucugagggagaucaguuuuagcacacauucuccagugaaaaggauuauaaaaaccacauuuauccaauauaaaacuucagucauauguugacuuugacccuccuuuucuaccaucaugguuaccauguugagacagauaagaaccaugauacuaauaucaaaggcuugauuugucacuaggucaaauauacauccuuggauuuuguucccuggucgaggaauuggcuuuuguggcuucuuggaccccagcuuuuucauugcauuauaguauuucuucuguucuucugucauaaagaugucuugaccuccaagcuucuuuuucuguugguugaaauuaucuaugaugacaccaaugaacaaguucaaagugaagaaugacccaaagaugauaaagacgacaaaauaaauauacauguagaggcuauauucauauuugggcugcuugucuacauuaacagaauccacugcugcauacauaauaaucguccaucccuuaaaaguugcaacuugaagcagagauagguaaccaaguccgacauuaucaaaguucacuuucagguuuuuccaucgcacauuuugacuaacauucauaagggcaaaacauucggaacgauuuggaacuugacuugcaggaaaccgugacccaucugugguguuaauacacucauagaacuugccagcaaacaaauuuacucccaugaugcugaauaucagccagaauauaagacacacaaguagcacauucaugauggaaggaauugcuccuaugagugcauucacaacgacccucauuccuucaaaucuagauaaggcucuuagaggucuuaaagcucucaguguccgaagggauuuaauggggccaagaucugaguagccaagaguguuugccacuaaaguaaccaaagaaacaucaacaauuaggaaauccagccaacaccaggcauuggugaaauauguuuuauaaccauaugcuauccauuuuagaagcauuuccagaaugaagauguaagugaagaucuugucugcauacuccaggauaaucuuaauggucuuuuuccuuucaauauaaauaucuucaaaagccagggcaccacugcugagcaggaucaugaggacaaugaagcuuucaaaccaacuguguucaacaaucuuguagcagguuuuccugauguuccaccagauuuuuccuuucccugacucuauguuaacuuggcagcaugagaaccuccguacacaaccaucugugaaacaggccucuggcucaucggaauucauagguucagccucugcuucuucuccuucuccaggcaaaggguuaucaacugugcugcacucugaggagcuugaccgguuuaaucucacuuugcuguauucacuauccgaaucacugcuaaguuccucagcauucauauuuuccaaaucggauuccccaggugcaauuggcacugucacugugaggcugggauugugaauaaaugauugaccaucacugucuuccaucaaguguuuguccacgcugcuuccaaaaccacugauuuuaucuuuuuccuugaggaaauugugaccuuugcucauuucagcaaguguaugguuagaaauauaguuuuccuucuuaguauucagaucuucugcuugucuuaucucccuggaaaucuuuggcuuuuuggaaaaugcuuuuagaauaaauucacguaagguuuguuucacauaauuuauucccuuuuuaauucuagucacugcaaucuggagguuguuugcaucagggucuucuucaauugcuguaagauugucugaacuaaaugagcucaauaauaaggccagaaauagguuuaggaccaccagguuuccaaugaccaugaccaucauguaaacaauaaggcacauagcuugaccagcgaccuccauacagucccacauggucucuauccacucuccacacagcacgcggaacacaaucaggaaggaguggaagaagucguucaugugccaccgugggagcguacagucaucauugaucuugcagacacauucuuuguagcucuuaccaaagagcugcaugccgaccacagcaaaaaugaagacgaugauggccaacacuaaggugagguuaccuagagccccuacugaguuaccaaugaucuuaaucagcauguucaauguuggccaggauuuugccaacuugaagacucggagcagucugaaugaucgcagaacugacaauccuuccacaucugcuagaaagagcuccacuaaacuuaaagucacaauaaggcugucaaaaauauuccagccuacuuggaaauacucauauggauccauggcaaucaguuuuaauaccauuucagcugcaaagauuccaguaaagaccaaauuuccuauagcaaguacauuuuugaauuccucagucauugggugguguuccauagccauaaauaauguguuuaaaacuaugcaaaugguaauugcaagaucuacaaaaggauccauuacaauaaaauagauacacuuuuugaauuuuauccaauauggagagcaauuccagaucaagaauuugugugcaaaucuguaccaccaagguggacauuuuugucuggacucuucaaguucuuccacaguguuuguuaauaugcuugcucuacucauugcucucugucugagguugggaucauucagcauauccucugaaaggagauaggaacuacaacgccuuuucuuguguauuugauuggucgugcccucuggcagaagcuguccauuggggagcaugagggcugagcguccaucaaccagggagaccacaccguugcaguccacagcacugugcauuuucccguucaccggcagcauugguggggaccuacuggcuuggcugauguuacugcugcgucgcuccuggggucuguggggcacaaacagugagccccuucugcucucauugucuccaaaaaugcugugcucaucaucggcaaauucagucucagauccuauaucucuuccucugccuuugaaacuaaaaagacuuguucugcugcuucgccuugcagaaaacaaggagccacgaaugcugaguggugacugauuggggguagacaaccucuuuucaugugcucgccuaugcccuucgacaccaagguggaaacuuuuucuucugaugcuguccucugauucugauuucgacaauuucucagcaucucccuuuuccucuccacuggagagcuucuuuugauucuuuuucuuucuucuguuucuucuuucuuuagcacuuuuagagcucaguuuggauguuucagaagaacucucugagaggcccauaauucugcuucuccuaauacuuguauauucagccgcugccgcugcaauugccucagcuucuucuugcucuuuuuuaagacggucuaacaucuguugaaauucuaauucuuucuguuuagcuucuucaauguuugccugguucuguucuucauaugccauggcaaccacagccaggaucaaguuuauuagauaaaaggagcccaggaaaaucacuacgacaaagaagaucauguagguuuugccagcagcacgcagcgucuguugguaaagguuuucccaguaaucuugggucauuagccuaaacaaggcuaagaaggcccagcugaaagugucaaagcucguguagccauaaucaggguuucugccaauuuucacacagguguaccccucuggacacugaccugaaucugugcugaaaccacaaaggagagcaucuuuggauccuuccaaguaauaaaaauauuuucuaaagucuucuucacucucuaggguauucauuaugcuuucuaauguuucauuauuuucaagugaauuucgaaaacauuuaugcuucagguuucccaugaacagcuguaguccaauuagugcaaacacacucagacagaacacagucaggaucaugacaucagaaagcuucuucacugacuggaucaaagccccuacaauugucuucaggccugggauuacagaaauaguuuucaaagcucucaauacucugaaaguucgaagagcugaaacauugccuagguuuacaaauucuguuaaauacgcaaaaacaaugacgacaaaauccagccaguuccacgggucacgaagaaaagugaauucuccuacacagaagccucuugcaaggauuuuuacaagugauucaaaaguauauauuccaguaaaaguguacucgacauuuuugguccaguccgguggguuauucauggucauaaauaugcaguuugucagaauagugcacaugaugagcaugcugaauaaggaguguacuaaaaucuuaauagauauucuucuuagaggacugaaaggagaaagcauauauaaagcagguguggcauugaaacggaagauuguuuucccuuuguucaauacuaugaaagucuuuuugucugcauaguagggguccaaguccuccaggggcucugacaccaugccgggaggaauguccccauagaugaagggcagcuguuugccagcuuccaagucacugcuuggcuuuggggcuucuucaucaucaucuuucuuuucuucuuuggguuccuuugauuuucuuucagcaaugcguuguucaaugagggcaagagacuguuuugugaaauggacaaagcucugagguccugggggaggcaacauugccaucuuuucauccuguauauuuuaauuccucuucagcuccucacauaagaggcuugcaaccuagcccgccgaucauccccacccagugcaccugcagaaucuggcuccaggagagggcgcgggccucuccuuccccggcgcucucucagggcugcuucuuuuucucugggcuccuguugcucaggggacgccugccgcuagcagccacuggcacccaggcuagcccagccucagccgagcuggcggaauuggaaagccgacagccgccgcuggagcgcuggcgaccgccugcaagcagacugcgccccuccugccagggcgcgcccguggagguagcagccccg

SEQ ID NO: 3 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucacaaaacagucucuugctt

SEQ ID NO: 4 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gcaagagacuguuuugugatt

SEQ ID NO: 5 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ggaaaacaaucuuccguuutt

SEQ ID NO: 6 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaacggaagauuguuuucctt

SEQ ID NO: 7 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gaaaacaaucuuccguuuctt

SEQ ID NO: 8 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gaaacggaagauuguuuuctt

SEQ ID NO: 9 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaaacaaucuuccguuucatt

SEQ ID NO: 10 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugaaacggaagauuguuuutt

SEQ ID NO: 11 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaacaaucuuccguuucaatt

SEQ ID NO: 12 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uugaaacggaagauuguuutt

SEQ ID NO: 13 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aacaaucuuccguuucaautt

SEQ ID NO: 14 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auugaaacggaagauuguutt

SEQ ID NO: 15 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
caaucuuccguuucaaugctt

SEQ ID NO: 16 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gcauugaaacggaagauugtt

SEQ ID NO: 17 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccugcuuuauauaugcuuutt

SEQ ID NO: 18 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaagcauauauaaagcaggtt

SEQ ID NO: 19 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cugcuuuauauaugcuuuctt

SEQ ID NO: 20 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gaaagcauauauaaagcagtt

SEQ ID NO: 21 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uaugcuuucuccuuucagutt

SEQ ID NO: 22 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acugaaaggagaaagcauatt

SEQ ID NO: 23 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
augcuuucuccuuucaguctt

SEQ ID NO: 24 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gacugaaaggagaaagcautt

SEQ ID NO: 25 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugcuuucuccuuucagucctt

SEQ ID NO: 26 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ggacugaaaggagaaagcatt

SEQ ID NO: 27 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cuuucuccuuucaguccuctt

SEQ ID NO: 28 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gaggacugaaaggagaaagtt

SEQ ID NO: 29 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucuccuuucaguccucuaatt

SEQ ID NO: 30 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuagaggacugaaaggagatt

SEQ ID NO: 31 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cuccuuucaguccucuaagtt

SEQ ID NO: 32 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cuuagaggacugaaaggagtt

SEQ ID NO: 33 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uccuuucaguccucuaagatt

SEQ ID NO: 34 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucuuagaggacugaaaggatt

SEQ ID NO: 35 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccuuucaguccucuaagaatt

SEQ ID NO: 36 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uucuuagaggacugaaaggtt

SEQ ID NO: 37 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cuuucaguccucuaagaagtt

SEQ ID NO: 38 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cuucuuagaggacugaaagtt

SEQ ID NO: 39 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aguccucuaagaagaauautt

SEQ ID NO: 40 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auauucuucuuagaggacutt

SEQ ID NO: 41 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uccucuaagaagaauaucutt

SEQ ID NO: 42 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agauauucuucuuagaggatt

SEQ ID NO: 43 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccucuaagaagaauaucuatt

SEQ ID NO: 44 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uagauauucuucuuagaggtt

SEQ ID NO: 45 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cucuaagaagaauaucuautt

SEQ ID NO: 46 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auagauauucuucuuagagtt

SEQ ID NO: 47 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auuuuaguacacuccuuautt

SEQ ID NO: 48 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auaaggaguguacuaaaautt

SEQ ID NO: 49 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uaguacacuccuuauucagtt

SEQ ID NO: 50 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cugaauaaggaguguacuatt

SEQ ID NO: 51 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aguacacuccuuauucagctt

SEQ ID NO: 52 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gcugaauaaggaguguacutt

SEQ ID NO: 53 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccuuauucagcaugcucautt

SEQ ID NO: 54 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
augagcaugcugaauaaggtt

SEQ ID NO: 55 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucaucaugugcacuauucutt

SEQ ID NO: 56 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agaauagugcacaugaugatt

SEQ ID NO: 57 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
caucaugugcacuauucugtt

SEQ ID NO: 58 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cagaauagugcacaugaugtt

SEQ ID NO: 59 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugucgaguacacuuuuacutt

SEQ ID NO: 60 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aguaaaaguguacucgacatt

SEQ ID NO: 61 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gucgaguacacuuuuacugtt

SEQ ID NO: 62 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
caguaaaaguguacucgactt

SEQ ID NO: 63 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cuucuguguaggagaauuctt

SEQ ID NO: 64 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gaauucuccuacacagaagtt

SEQ ID NO: 65 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uaggagaauucacuuuucutt

SEQ ID NO: 66 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agaaaagugaauucuccuatt

SEQ ID NO: 67 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aggagaauucacuuuucuutt

SEQ ID NO: 68 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aagaaaagugaauucuccutt

SEQ ID NO: 69 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ggagaauucacuuuucuuctt

SEQ ID NO: 70 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gaagaaaagugaauucucctt

SEQ ID NO: 71 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ggcaauguuucagcucuuctt

SEQ ID NO: 72 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gaagagcugaaacauugcctt

SEQ ID NO: 73 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aauguuucagcucuucgaatt

SEQ ID NO: 74 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uucgaagagcugaaacauutt

SEQ ID NO: 75 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
guuucagcucuucgaacuutt

SEQ ID NO: 76 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaguucgaagagcugaaactt

SEQ ID NO: 77 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucagcucuucgaacuuucatt

SEQ ID NO: 78 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugaaaguucgaagagcugatt

SEQ ID NO: 79 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agcucuucgaacuuucagatt

SEQ ID NO: 80 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucugaaaguucgaagagcutt

SEQ ID NO: 81 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cucuucgaacuuucagagutt

SEQ ID NO: 82 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acucugaaaguucgaagagtt

SEQ ID NO: 83 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cuucgaacuuucagaguautt

SEQ ID NO: 84 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auacucugaaaguucgaagtt

SEQ ID NO: 85 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uccugacuguguucugucutt

SEQ ID NO: 86 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agacagaacacagucaggatt

SEQ ID NO: 87 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cugacuguguucugucugatt

SEQ ID NO: 88 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucagacagaacacagucagtt

SEQ ID NO: 89 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugacuguguucugucugagtt

SEQ ID NO: 90 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cucagacagaacacagucatt

SEQ ID NO: 91 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gacuguguucugucugagutt

SEQ ID NO: 92 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acucagacagaacacaguctt

SEQ ID NO: 93 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acuguguucugucugagugtt

SEQ ID NO: 94 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cacucagacagaacacagutt

SEQ ID NO: 95 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cuguguucugucugagugutt

SEQ ID NO: 96 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acacucagacagaacacagtt

SEQ ID NO: 97 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uguguucugucugagugugtt

SEQ ID NO: 98 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cacacucagacagaacacatt

SEQ ID NO: 99 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uguucugucugaguguguutt

SEQ ID NO: 100 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aacacacucagacagaacatt

SEQ ID NO: 101 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
guucugucugaguguguuutt

SEQ ID NO: 102 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaacacacucagacagaactt

SEQ ID NO: 103 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uucugucugaguguguuugtt

SEQ ID NO: 104 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
caaacacacucagacagaatt

SEQ ID NO: 105 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucugucugaguguguuugctt

SEQ ID NO: 106 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gcaaacacacucagacagatt

SEQ ID NO: 107 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugcucuccuuugugguuuctt

SEQ ID NO: 108 - DNA, 21 bp, Artificial Sequence
  source: /note="Description of Artificial Sequence: Synthetic oligonucleotide"
gaaaccacaaaggagagcatt

SEQ ID NO: 109 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cucuccuuugugguuucagtt

SEQ ID NO: 110 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cugaaaccacaaaggagagtt

SEQ ID NO: 111 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucuccuuugugguuucagctt

SEQ ID NO: 112 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gcugaaaccacaaaggagatt

SEQ ID NO: 113 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cuccuuugugguuucagcatt

SEQ ID NO: 114 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugcugaaaccacaaaggagtt

SEQ ID NO: 115 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cgagcuuugacacuuucagtt

SEQ ID NO: 116 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cugaaagugucaaagcucgtt

SEQ ID NO: 117 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acaugaucuucuuugucgutt

SEQ ID NO: 118 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acgacaaagaagaucaugutt

SEQ ID NO: 119 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
caugaucuucuuugucguatt

SEQ ID NO: 120 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uacgacaaagaagaucaugtt

SEQ ID NO: 121 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gaucuucuuugucguagugtt

SEQ ID NO: 122 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cacuacgacaaagaagauctt

SEQ ID NO: 123 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucuucuuugucguagugautt

SEQ ID NO: 124 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aucacuacgacaaagaagatt

SEQ ID NO: 125 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cuucuuugucguagugauutt

SEQ ID NO: 126 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaucacuacgacaaagaagtt

SEQ ID NO: 127 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uugucguagugauuuuccutt

SEQ ID NO: 128 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aggaaaaucacuacgacaatt

SEQ ID NO: 129 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gcuccuuuuaucuaauaaatt

SEQ ID NO: 130 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuuauuagauaaaaggagctt

SEQ ID NO: 131 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cuccuuuuaucuaauaaactt

SEQ ID NO: 132 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
guuuauuagauaaaaggagtt

SEQ ID NO: 133 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccucucagagaguucuucutt

SEQ ID NO: 134 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agaagaacucucugagaggtt

SEQ ID NO: 135 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cucucagagaguucuucugtt

SEQ ID NO: 136 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cagaagaacucucugagagtt

SEQ ID NO: 137 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucucagagaguucuucugatt

SEQ ID NO: 138 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucagaagaacucucugagatt

SEQ ID NO: 139 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cucagagaguucuucugaatt

SEQ ID NO: 140 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uucagaagaacucucugagtt

SEQ ID NO: 141 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucagagaguucuucugaaatt

SEQ ID NO: 142 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuucagaagaacucucugatt

SEQ ID NO: 143 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cagagaguucuucugaaactt

SEQ ID NO: 144 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
guuucagaagaacucucugtt

SEQ ID NO: 145 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gagaguucuucugaaacautt

SEQ ID NO: 146 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auguuucagaagaacucuctt

SEQ ID NO: 147 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agaguucuucugaaacauctt

SEQ ID NO: 148 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gauguuucagaagaacucutt

SEQ ID NO: 149 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gaguucuucugaaacaucctt

SEQ ID NO: 150 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ggauguuucagaagaacuctt

SEQ ID NO: 151 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aguucuucugaaacauccatt

SEQ ID NO: 152 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uggauguuucagaagaacutt

SEQ ID NO: 153 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
guucuucugaaacauccaatt

SEQ ID NO: 154 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuggauguuucagaagaactt

SEQ ID NO: 155 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucuucugaaacauccaaactt

SEQ ID NO: 156 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
guuuggauguuucagaagatt

SEQ ID NO: 157 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cuucugaaacauccaaacutt

SEQ ID NO: 158 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aguuuggauguuucagaagtt

SEQ ID NO: 159 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucugaaacauccaaacugatt

SEQ ID NO: 160 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucaguuuggauguuucagatt

SEQ ID NO: 161 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uccaaacugagcucuaaaatt

SEQ ID NO: 162 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuuuagagcucaguuuggatt

SEQ ID NO: 163 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aggcguuguaguuccuauctt

SEQ ID NO: 164 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gauaggaacuacaacgccutt

SEQ ID NO: 165 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gcguuguaguuccuaucuctt

SEQ ID NO: 166 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gagauaggaacuacaacgctt

SEQ ID NO: 167 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cguuguaguuccuaucucctt

SEQ ID NO: 168 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ggagauaggaacuacaacgtt

SEQ ID NO: 169 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
guuguaguuccuaucuccutt

SEQ ID NO: 170 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aggagauaggaacuacaactt

SEQ ID NO: 171 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuguaguuccuaucuccuutt

SEQ ID NO: 172 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaggagauaggaacuacaatt

SEQ ID NO: 173 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uguaguuccuaucuccuuutt

SEQ ID NO: 174 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaaggagauaggaacuacatt

SEQ ID NO: 175 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
guaguuccuaucuccuuuctt

SEQ ID NO: 176 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gaaaggagauaggaacuactt

SEQ ID NO: 177 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uaguuccuaucuccuuucatt

SEQ ID NO: 178 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugaaaggagauaggaacuatt

SEQ ID NO: 179 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aguuccuaucuccuuucagtt

SEQ ID NO: 180 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cugaaaggagauaggaacutt

SEQ ID NO: 181 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
guuccuaucuccuuucagatt

SEQ ID NO: 182 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucugaaaggagauaggaactt

SEQ ID NO: 183 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuccuaucuccuuucagagtt

SEQ ID NO: 184 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cucugaaaggagauaggaatt

SEQ ID NO: 185 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uccuaucuccuuucagaggtt

SEQ ID NO: 186 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccucugaaaggagauaggatt

SEQ ID NO: 187 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucuccuuucagaggauaugtt

SEQ ID NO: 188 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cauauccucugaaaggagatt

SEQ ID NO: 189 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gcauauuaacaaacacugutt

SEQ ID NO: 190 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acaguguuuguuaauaugctt

SEQ ID NO: 191 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cuugaucuggaauugcucutt

SEQ ID NO: 192 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agagcaauuccagaucaagtt

SEQ ID NO: 193 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cucuccauauuggauaaaatt

SEQ ID NO: 194 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuuuauccaauauggagagtt

SEQ ID NO: 195 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucuccauauuggauaaaautt

SEQ ID NO: 196 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auuuuauccaauauggagatt

SEQ ID NO: 197 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cuccauauuggauaaaauutt

SEQ ID NO: 198 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aauuuuauccaauauggagtt

SEQ ID NO: 199 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gaucuugcaauuaccauuutt

SEQ ID NO: 200 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaaugguaauugcaagauctt

SEQ ID NO: 201 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuggucuuuacuggaaucutt

SEQ ID NO: 202 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agauuccaguaaagaccaatt

SEQ ID NO: 203 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ggucuuuacuggaaucuuutt

SEQ ID NO: 204 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaagauuccaguaaagacctt

SEQ ID NO: 205 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gucuuuacuggaaucuuugtt

SEQ ID NO: 206 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
caaagauuccaguaaagactt

SEQ ID NO: 207 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gccuuauugugacuuuaagtt

SEQ ID NO: 208 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cuuaaagucacaauaaggctt

SEQ ID NO: 209 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gcucuuucuagcagaugugtt

SEQ ID NO: 210 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cacaucugcuagaaagagctt

SEQ ID NO: 211 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cucuuucuagcagauguggtt

SEQ ID NO: 212 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccacaucugcuagaaagagtt

SEQ ID NO: 213 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gucaguucugcgaucauuctt

SEQ ID NO: 214 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gaaugaucgcagaacugactt

SEQ ID NO: 215 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucaguucugcgaucauucatt

SEQ ID NO: 216 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugaaugaucgcagaacugatt

SEQ ID NO: 217 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agucuucaaguuggcaaaatt

SEQ ID NO: 218 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuuugccaacuugaagacutt

SEQ ID NO: 219 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucuucaaguuggcaaaauctt

SEQ ID NO: 220 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gauuuugccaacuugaagatt

SEQ ID NO: 221 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cuucaaguuggcaaaaucctt

SEQ ID NO: 222 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ggauuuugccaacuugaagtt

SEQ ID NO: 223 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccaucaucgucuucauuuutt

SEQ ID NO: 224 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaaaugaagacgaugauggtt

SEQ ID NO: 225 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
caucaucgucuucauuuuutt

SEQ ID NO: 226 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaaaaugaagacgaugaugtt

SEQ ID NO: 227 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gcacaugaacgacuucuuctt

SEQ ID NO: 228 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gaagaagucguucaugugctt

SEQ ID NO: 229 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cacaugaacgacuucuucctt

SEQ ID NO: 230 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ggaagaagucguucaugugtt

SEQ ID NO: 231 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acaugaacgacuucuuccatt

SEQ ID NO: 232 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uggaagaagucguucaugutt

SEQ ID NO: 233 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
caugaacgacuucuuccactt

SEQ ID NO: 234 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
guggaagaagucguucaugtt

SEQ ID NO: 235 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugaacgacuucuuccacuctt

SEQ ID NO: 236 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gaguggaagaagucguucatt

SEQ ID NO: 237 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cgacuucuuccacuccuuctt

SEQ ID NO: 238 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gaaggaguggaagaagucgtt

SEQ ID NO: 239 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uccacuccuuccugauugutt

SEQ ID NO: 240 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acaaucaggaaggaguggatt

SEQ ID NO: 241 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acuccuuccugauuguguutt

SEQ ID NO: 242 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aacacaaucaggaaggagutt

SEQ ID NO: 243 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cuccuuccugauuguguuctt

SEQ ID NO: 244 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gaacacaaucaggaaggagtt

SEQ ID NO: 245 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uccuuccugauuguguucctt

SEQ ID NO: 246 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ggaacacaaucaggaaggatt

SEQ ID NO: 247 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cuaugugccuuauuguuuatt

SEQ ID NO: 248 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uaaacaauaaggcacauagtt

SEQ ID NO: 249 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugguccuaaaccuauuucutt

SEQ ID NO: 250 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agaaauagguuuaggaccatt

SEQ ID NO: 251 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gguccuaaaccuauuucugtt

SEQ ID NO: 252 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cagaaauagguuuaggacctt

SEQ ID NO: 253 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
guccuaaaccuauuucuggtt

SEQ ID NO: 254 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccagaaauagguuuaggactt

SEQ ID NO: 255 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccuuacgugaauuuauucutt

SEQ ID NO: 256 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agaauaaauucacguaaggtt

SEQ ID NO: 257 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
caaaggucacaauuuccuctt

SEQ ID NO: 258 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gaggaaauugugaccuuugtt

SEQ ID NO: 259 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucacaauuuccucaaggaatt

SEQ ID NO: 260 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuccuugaggaaauugugatt

SEQ ID NO: 261 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccucaaggaaaaagauaaatt

SEQ ID NO: 262 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuuaucuuuuuccuugaggtt

SEQ ID NO: 263 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gcuucauuguccucaugautt

SEQ ID NO: 264 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aucaugaggacaaugaagctt

SEQ ID NO: 265 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cuucauuguccucaugauctt

SEQ ID NO: 266 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gaucaugaggacaaugaagtt

SEQ ID NO: 267 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugcagacaagaucuucacutt

SEQ ID NO: 268 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agugaagaucuugucugcatt

SEQ ID NO: 269 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cagacaagaucuucacuuatt

SEQ ID NO: 270 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uaagugaagaucuugucugtt

SEQ ID NO: 271 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agacaagaucuucacuuactt

SEQ ID NO: 272 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
guaagugaagaucuugucutt

SEQ ID NO: 273 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gacaagaucuucacuuacatt

SEQ ID NO: 274 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uguaagugaagaucuuguctt

SEQ ID NO: 275 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acaagaucuucacuuacautt

SEQ ID NO: 276 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auguaagugaagaucuugutt

SEQ ID NO: 277 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
caagaucuucacuuacauctt

SEQ ID NO: 278 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gauguaagugaagaucuugtt

SEQ ID NO: 279 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agaucuucacuuacaucuutt

SEQ ID NO: 280 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aagauguaagugaagaucutt

SEQ ID NO: 281 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gaucuucacuuacaucuuctt

SEQ ID NO: 282 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gaagauguaagugaagauctt

SEQ ID NO: 283 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucuucacuuacaucuucautt

SEQ ID NO: 284 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
augaagauguaagugaagatt

SEQ ID NO: 285 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cuucacuuacaucuucauutt

SEQ ID NO: 286 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaugaagauguaagugaagtt

SEQ ID NO: 287 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uucacuuacaucuucauuctt

SEQ ID NO: 288 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gaaugaagauguaagugaatt

SEQ ID NO: 289 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucacuuacaucuucauucutt

SEQ ID NO: 290 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agaaugaagauguaagugatt

SEQ ID NO: 291 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cacuuacaucuucauucugtt

SEQ ID NO: 292 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cagaaugaagauguaagugtt

SEQ ID NO: 293 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cuuacaucuucauucuggatt

SEQ ID NO: 294 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uccagaaugaagauguaagtt

SEQ ID NO: 295 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acaucuucauucuggaaautt

SEQ ID NO: 296 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auuuccagaaugaagaugutt

SEQ ID NO: 297 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
caucuucauucuggaaaugtt

SEQ ID NO: 298 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cauuuccagaaugaagaugtt

SEQ ID NO: 299 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucuucauucuggaaaugcutt

SEQ ID NO: 300 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agcauuuccagaaugaagatt

SEQ ID NO: 301 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cuucauucuggaaaugcuutt

SEQ ID NO: 302 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aagcauuuccagaaugaagtt

SEQ ID NO: 303 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucuggaaaugcuucuaaaatt

SEQ ID NO: 304 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuuuagaagcauuuccagatt

SEQ ID NO: 305 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gcuggauuuccuaauuguutt

SEQ ID NO: 306 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aacaauuaggaaauccagctt

SEQ ID NO: 307 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cuggauuuccuaauuguugtt

SEQ ID NO: 308 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
caacaauuaggaaauccagtt

SEQ ID NO: 309 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccucuaagagccuuaucuatt

SEQ ID NO: 310 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uagauaaggcucuuagaggtt

SEQ ID NO: 311 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cucuaagagccuuaucuagtt

SEQ ID NO: 312 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cuagauaaggcucuuagagtt

SEQ ID NO: 313 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cuuccaucaugaaugugcutt

SEQ ID NO: 314 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agcacauucaugauggaagtt

SEQ ID NO: 315 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuuccugcaagucaaguuctt

SEQ ID NO: 316 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gaacuugacuugcaggaaatt

SEQ ID NO: 317 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cugcaagucaaguuccaaatt

SEQ ID NO: 318 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuuggaacuugacuugcagtt

SEQ ID NO: 319 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agucaaguuccaaaucguutt

SEQ ID NO: 320 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aacgauuuggaacuugacutt

SEQ ID NO: 321 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acuugguuaccuaucucugtt

SEQ ID NO: 322 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cagagauagguaaccaagutt

SEQ ID NO: 323 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cuugguuaccuaucucugctt

SEQ ID NO: 324 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gcagagauagguaaccaagtt

SEQ ID NO: 325 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gguuaccuaucucugcuuctt

SEQ ID NO: 326 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gaagcagagauagguaacctt

SEQ ID NO: 327 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
guuaccuaucucugcuucatt

SEQ ID NO: 328 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugaagcagagauagguaactt

SEQ ID NO: 329 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuaccuaucucugcuucaatt

SEQ ID NO: 330 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uugaagcagagauagguaatt

SEQ ID NO: 331 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uaccuaucucugcuucaagtt

SEQ ID NO: 332 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cuugaagcagagauagguatt

SEQ ID NO: 333 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
accuaucucugcuucaagutt

SEQ ID NO: 334 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acuugaagcagagauaggutt

SEQ ID NO: 335 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccuaucucugcuucaaguutt

SEQ ID NO: 336 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aacuugaagcagagauaggtt

SEQ ID NO: 337 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cuaucucugcuucaaguugtt

SEQ ID NO: 338 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
caacuugaagcagagauagtt

SEQ ID NO: 339 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aucucugcuucaaguugcatt

SEQ ID NO: 340 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugcaacuugaagcagagautt

SEQ ID NO: 341 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucucugcuucaaguugcaatt

SEQ ID NO: 342 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uugcaacuugaagcagagatt

SEQ ID NO: 343 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cucugcuucaaguugcaactt

SEQ ID NO: 344 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
guugcaacuugaagcagagtt

SEQ ID NO: 345 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucugcuucaaguugcaacutt

SEQ ID NO: 346 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aguugcaacuugaagcagatt

SEQ ID NO: 347 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uaucaucuuugggucauuctt

SEQ ID NO: 348 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gaaugacccaaagaugauatt

SEQ ID NO: 349 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aucaucuuugggucauucutt

SEQ ID NO: 350 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agaaugacccaaagaugautt

SEQ ID NO: 351 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucaucuuugggucauucuutt

SEQ ID NO: 352 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aagaaugacccaaagaugatt

SEQ ID NO: 353 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
caucuuugggucauucuuctt

SEQ ID NO: 354 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gaagaaugacccaaagaugtt

SEQ ID NO: 355 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cuuugggucauucuucacutt

SEQ ID NO: 356 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agugaagaaugacccaaagtt

SEQ ID NO: 357 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uugggucauucuucacuuutt

SEQ ID NO: 358 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaagugaagaaugacccaatt

SEQ ID NO: 359 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugggucauucuucacuuugtt

SEQ ID NO: 360 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
caaagugaagaaugacccatt

SEQ ID NO: 361 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gggucauucuucacuuugatt

SEQ ID NO: 362 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucaaagugaagaaugaccctt

SEQ ID NO: 363 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ggucauucuucacuuugaatt

SEQ ID NO: 364 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uucaaagugaagaaugacctt

SEQ ID NO: 365 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gucauucuucacuuugaactt

SEQ ID NO: 366 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
guucaaagugaagaaugactt

SEQ ID NO: 367 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cauucuucacuuugaacuutt

SEQ ID NO: 368 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaguucaaagugaagaaugtt

SEQ ID NO: 369 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucacuuugaacuuguucautt

SEQ ID NO: 370 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
augaacaaguucaaagugatt

SEQ ID NO: 371 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cuuguucauuggugucauctt

SEQ ID NO: 372 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gaugacaccaaugaacaagtt

SEQ ID NO: 373 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gugucaucauagauaauuutt

SEQ ID NO: 374 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaauuaucuaugaugacactt

SEQ ID NO: 375 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugucaucauagauaauuuctt

SEQ ID NO: 376 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gaaauuaucuaugaugacatt

SEQ ID NO: 377 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gaggucaagacaucuuuautt

SEQ ID NO: 378 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auaaagaugucuugaccuctt

SEQ ID NO: 379 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aggucaagacaucuuuaugtt

SEQ ID NO: 380 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cauaaagaugucuugaccutt

SEQ ID NO: 381 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ggucaagacaucuuuaugatt

SEQ ID NO: 382 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucauaaagaugucuugacctt

SEQ ID NO: 383 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccacaaaagccaauuccuctt

SEQ ID NO: 384 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gaggaauuggcuuuuguggtt

SEQ ID NO: 385 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gaccuagugacaaaucaagtt

SEQ ID NO: 386 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cuugauuugucacuagguctt

SEQ ID NO: 387 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
guaucaugguucuuaucugtt

SEQ ID NO: 388 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cagauaagaaccaugauactt

SEQ ID NO: 389 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uaucaugguucuuaucugutt

SEQ ID NO: 390 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acagauaagaaccaugauatt

SEQ ID NO: 391 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucaugguucuuaucugucutt

SEQ ID NO: 392 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agacagauaagaaccaugatt

SEQ ID NO: 393 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
caugguucuuaucugucuctt

SEQ ID NO: 394 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gagacagauaagaaccaugtt

SEQ ID NO: 395 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
augguucuuaucugucucatt

SEQ ID NO: 396 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugagacagauaagaaccautt

SEQ ID NO: 397 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugguucuuaucugucucaatt

SEQ ID NO: 398 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uugagacagauaagaaccatt

SEQ ID NO: 399 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gguucuuaucugucucaactt

SEQ ID NO: 400 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
guugagacagauaagaacctt

SEQ ID NO: 401 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
guucuuaucugucucaacatt

SEQ ID NO: 402 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uguugagacagauaagaactt

SEQ ID NO: 403 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucuuaucugucucaacaugtt

SEQ ID NO: 404 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cauguugagacagauaagatt

SEQ ID NO: 405 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aucugucucaacaugguaatt

SEQ ID NO: 406 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuaccauguugagacagautt

SEQ ID NO: 407 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucugucucaacaugguaactt

SEQ ID NO: 408 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
guuaccauguugagacagatt

SEQ ID NO: 409 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cugucucaacaugguaacctt

SEQ ID NO: 410 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gguuaccauguugagacagtt

SEQ ID NO: 411 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uccuggucauguucaucuatt

SEQ ID NO: 412 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uagaugaacaugaccaggatt

SEQ ID NO: 413 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aguucauccuggaaguucatt

SEQ ID NO: 414 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugaacuuccaggaugaacutt

SEQ ID NO: 415 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccaucuguuggaauauucutt

SEQ ID NO: 416 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agaauauuccaacagauggtt

SEQ ID NO: 417 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
caucuguuggaauauucuatt

SEQ ID NO: 418 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uagaauauuccaacagaugtt

SEQ ID NO: 419 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucuguuggaauauucuacutt

SEQ ID NO: 420 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aguagaauauuccaacagatt

SEQ ID NO: 421 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cauacuggagaauuuuagutt

SEQ ID NO: 422 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acuaaaauucuccaguaugtt

SEQ ID NO: 423 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cuccucuucucauagcaaatt

SEQ ID NO: 424 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuugcuaugagaagaggagtt

SEQ ID NO: 425 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uccucuucucauagcaaaatt

SEQ ID NO: 426 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuuugcuaugagaagaggatt

SEQ ID NO: 427 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccucuucucauagcaaaactt

SEQ ID NO: 428 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
guuuugcuaugagaagaggtt

SEQ ID NO: 429 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cucuucucauagcaaaacctt

SEQ ID NO: 430 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gguuuugcuaugagaagagtt

SEQ ID NO: 431 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gauccauugucuugacauctt

SEQ ID NO: 432 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gaugucaagacaauggauctt

SEQ ID NO: 433 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auccauugucuugacaucutt

SEQ ID NO: 434 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agaugucaagacaauggautt

SEQ ID NO: 435 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uccauugucuugacaucuutt

SEQ ID NO: 436 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aagaugucaagacaauggatt

SEQ ID NO: 437 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cauugucuugacaucuuautt

SEQ ID NO: 438 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auaagaugucaagacaaugtt

SEQ ID NO: 439 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uugucuugacaucuuauuutt

SEQ ID NO: 440 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaauaagaugucaagacaatt

SEQ ID NO: 441 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugucuugacaucuuauuugtt

SEQ ID NO: 442 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
caaauaagaugucaagacatt

SEQ ID NO: 443 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gucuugacaucuuauuugctt

SEQ ID NO: 444 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gcaaauaagaugucaagactt

SEQ ID NO: 445 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ggagauggauucucuucgutt

SEQ ID NO: 446 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acgaagagaauccaucucctt

SEQ ID NO: 447 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gagauggauucucuucguutt

SEQ ID NO: 448 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aacgaagagaauccaucuctt

SEQ ID NO: 449 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agauggauucucuucguuctt

SEQ ID NO: 450 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gaacgaagagaauccaucutt

SEQ ID NO: 451 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gauggauucucuucguucatt

SEQ ID NO: 452 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugaacgaagagaauccauctt

SEQ ID NO: 453 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auggauucucuucguucactt

SEQ ID NO: 454 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gugaacgaagagaauccautt

SEQ ID NO: 455 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uggauucucuucguucacatt

SEQ ID NO: 456 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugugaacgaagagaauccatt

SEQ ID NO: 457 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ggauucucuucguucacagtt

SEQ ID NO: 458 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cugugaacgaagagaaucctt

SEQ ID NO: 459 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gauucucuucguucacagatt

SEQ ID NO: 460 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucugugaacgaagagaauctt

SEQ ID NO: 461 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uucucuucguucacagaugtt

SEQ ID NO: 462 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
caucugugaacgaagagaatt

SEQ ID NO: 463 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucucuucguucacagauggtt

SEQ ID NO: 464 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccaucugugaacgaagagatt

SEQ ID NO: 465 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cucuucguucacagauggatt

SEQ ID NO: 466 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uccaucugugaacgaagagtt

SEQ ID NO: 467 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucuucguucacagauggaatt

SEQ ID NO: 468 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuccaucugugaacgaagatt

SEQ ID NO: 469 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agguucaugucugcaaauctt

SEQ ID NO: 470 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gauuugcagacaugaaccutt

SEQ ID NO: 471 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucugcaaauccuuccaaagtt

SEQ ID NO: 472 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cuuuggaaggauuugcagatt

SEQ ID NO: 473 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cugcaaauccuuccaaagutt

SEQ ID NO: 474 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acuuuggaaggauuugcagtt

SEQ ID NO: 475 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gugucugcuacugucauuctt

SEQ ID NO: 476 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gaaugacaguagcagacactt

SEQ ID NO: 477 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugucugcuacugucauucatt

SEQ ID NO: 478 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugaaugacaguagcagacatt

SEQ ID NO: 479 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gucugcuacugucauucagtt

SEQ ID NO: 480 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cugaaugacaguagcagactt

SEQ ID NO: 481 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
accgcuuaaggcaaaaugutt

SEQ ID NO: 482 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acauuuugccuuaagcggutt

SEQ ID NO: 483 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccgcuuaaggcaaaauguctt

SEQ ID NO: 484 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gacauuuugccuuaagcggtt

SEQ ID NO: 485 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucuccaccuucauaugauatt

SEQ ID NO: 486 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uaucauaugaagguggagatt

SEQ ID NO: 487 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugccaaaauccuuuuuauctt

SEQ ID NO: 488 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gauaaaaaggauuuuggcatt

SEQ ID NO: 489 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gccaaaauccuuuuuaucatt

SEQ ID NO: 490 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugauaaaaaggauuuuggctt

SEQ ID NO: 491 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucguaagagaacucuguagtt

SEQ ID NO: 492 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cuacagaguucucuuacgatt

SEQ ID NO: 493 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucugccuugucaucuuuuctt

SEQ ID NO: 494 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gaaaagaugacaaggcagatt

SEQ ID NO: 495 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cugccuugucaucuuuucatt

SEQ ID NO: 496 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugaaaagaugacaaggcagtt

SEQ ID NO: 497 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugccuugucaucuuuucactt

SEQ ID NO: 498 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gugaaaagaugacaaggcatt

SEQ ID NO: 499 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gccuugucaucuuuucacatt

SEQ ID NO: 500 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugugaaaagaugacaaggctt

SEQ ID NO: 501 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccuugucaucuuuucacagtt

SEQ ID NO: 502 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cugugaaaagaugacaaggtt

SEQ ID NO: 503 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
caucuuuucacaggauugutt

SEQ ID NO: 504 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acaauccugugaaaagaugtt

SEQ ID NO: 505 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cccauguaaauaaacaacatt

SEQ ID NO: 506 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uguuguuuauuuacaugggtt

SEQ ID NO: 507 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cauucaucuugacucacautt

SEQ ID NO: 508 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
augugagucaagaugaaugtt

SEQ ID NO: 509 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acauauuacacuccucaaatt

SEQ ID NO: 510 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuugaggaguguaauaugutt

SEQ ID NO: 511 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cauauuacacuccucaaaatt

SEQ ID NO: 512 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuuugaggaguguaauaugtt

SEQ ID NO: 513 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugcccaaaauacugauaautt

SEQ ID NO: 514 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auuaucaguauuuugggcatt

SEQ ID NO: 515 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gcccaaaauacugauaauatt

SEQ ID NO: 516 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uauuaucaguauuuugggctt

SEQ ID NO: 517 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cugauaauagucucuuaaatt

SEQ ID NO: 518 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuuaagagacuauuaucagtt

SEQ ID NO: 519 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gucaaauuuuccugcuuuctt

SEQ ID NO: 520 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gaaagcaggaaaauuugactt

SEQ ID NO: 521 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucaaauuuuccugcuuucutt

SEQ ID NO: 522 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agaaagcaggaaaauuugatt

SEQ ID NO: 523 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
caaauuuuccugcuuucuutt

SEQ ID NO: 524 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aagaaagcaggaaaauuugtt

SEQ ID NO: 525 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auuguuuagucauccuuuctt

SEQ ID NO: 526 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gaaaggaugacuaaacaautt

SEQ ID NO: 527 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gcaucacuuguauacaauctt

SEQ ID NO: 528 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gauuguauacaagugaugctt

SEQ ID NO: 529 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
caccaacuuacuuuccuaatt

SEQ ID NO: 530 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuaggaaaguaaguuggugtt

SEQ ID NO: 531 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
accaacuuacuuuccuaaatt

SEQ ID NO: 532 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuuaggaaaguaaguuggutt

SEQ ID NO: 533 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccaacuuacuuuccuaaautt

SEQ ID NO: 534 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auuuaggaaaguaaguuggtt

SEQ ID NO: 535 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
caacuuacuuuccuaaauutt

SEQ ID NO: 536 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aauuuaggaaaguaaguugtt

SEQ ID NO: 537 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aggaagaugucaccuucuctt

SEQ ID NO: 538 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gagaaggugacaucuuccutt

SEQ ID NO: 539 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gaagaugucaccuucuccutt

SEQ ID NO: 540 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aggagaaggugacaucuuctt

SEQ ID NO: 541 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agaugucaccuucuccuuatt

SEQ ID NO: 542 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uaaggagaaggugacaucutt

SEQ ID NO: 543 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gaugucaccuucuccuuaatt

SEQ ID NO: 544 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuaaggagaaggugacauctt

SEQ ID NO: 545 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
augucaccuucuccuuaaatt

SEQ ID NO: 546 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuuaaggagaaggugacautt

SEQ ID NO: 547 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugucaccuucuccuuaaaatt

SEQ ID NO: 548 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuuuaaggagaaggugacatt

SEQ ID NO: 549 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gucaccuucuccuuaaaautt

SEQ ID NO: 550 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auuuuaaggagaaggugactt

SEQ ID NO: 551 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucaccuucuccuuaaaauutt

SEQ ID NO: 552 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aauuuuaaggagaaggugatt

SEQ ID NO: 553 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
accuucuccuuaaaauucutt

SEQ ID NO: 554 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agaauuuuaaggagaaggutt

SEQ ID NO: 555 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccuucuccuuaaaauucuatt

SEQ ID NO: 556 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uagaauuuuaaggagaaggtt

SEQ ID NO: 557 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cuucuccuuaaaauucuautt

SEQ ID NO: 558 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auagaauuuuaaggagaagtt

SEQ ID NO: 559 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugagaucuuucuucuauaatt

SEQ ID NO: 560 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuauagaagaaagaucucatt

SEQ ID NO: 561 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gaucuuucuucuauaaagutt

SEQ ID NO: 562 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acuuuauagaagaaagauctt

SEQ ID NO: 563 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uaccaucuuagguucauuctt

SEQ ID NO: 564 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gaaugaaccuaagaugguatt

SEQ ID NO: 565 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
accaucuuagguucauucatt

SEQ ID NO: 566 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugaaugaaccuaagauggutt

SEQ ID NO: 567 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccaucuuagguucauucautt

SEQ ID NO: 568 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
augaaugaaccuaagauggtt

SEQ ID NO: 569 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
caucuuagguucauucauctt

SEQ ID NO: 570 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gaugaaugaaccuaagaugtt

SEQ ID NO: 571 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucuuagguucauucaucuutt

SEQ ID NO: 572 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aagaugaaugaaccuaagatt

SEQ ID NO: 573 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cuuagguucauucaucuuatt

SEQ ID NO: 574 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uaagaugaaugaaccuaagtt

SEQ ID NO: 575 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuagguucauucaucuuagtt

SEQ ID NO: 576 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cuaagaugaaugaaccuaatt

SEQ ID NO: 577 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uagguucauucaucuuaggtt

SEQ ID NO: 578 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccuaagaugaaugaaccuatt

SEQ ID NO: 579 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cugcauuaugaauacuuactt

SEQ ID NO: 580 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
guaaguauucauaaugcagtt

SEQ ID NO: 581 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acacaauuucuucuuagcatt

SEQ ID NO: 582 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugcuaagaagaaauugugutt

SEQ ID NO: 583 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
guucuuuuuccuauuucautt

SEQ ID NO: 584 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
augaaauaggaaaaagaactt

SEQ ID NO: 585 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uccuauuucaugaacuaugtt

SEQ ID NO: 586 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cauaguucaugaaauaggatt

SEQ ID NO: 587 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccuauuucaugaacuaugutt

SEQ ID NO: 588 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acauaguucaugaaauaggtt

SEQ ID NO: 589 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
augucuacuugugacuuuutt

SEQ ID NO: 590 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaaagucacaaguagacautt

SEQ ID NO: 591 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugucuacuugugacuuuuutt

SEQ ID NO: 592 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaaaagucacaaguagacatt

SEQ ID NO: 593 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucuacuugugacuuuuuautt

SEQ ID NO: 594 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auaaaaagucacaaguagatt

SEQ ID NO: 595 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cuacuugugacuuuuuauctt

SEQ ID NO: 596 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gauaaaaagucacaaguagtt

SEQ ID NO: 597 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
guucuaaauagcuauuucatt

SEQ ID NO: 598 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugaaauagcuauuuagaactt

SEQ ID NO: 599 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gcuguuuacauaggauucutt

SEQ ID NO: 600 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agaauccuauguaaacagctt

SEQ ID NO: 601 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gcucaaaauguuugaguuutt

SEQ ID NO: 602 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaacucaaacauuuugagctt

SEQ ID NO: 603 - RNA, 19 nt, Artificial Sequence
  source: /note="Description of Artificial Sequence: Synthetic oligonucleotide"
ucacaaaacagucucuugc

SEQ ID NO: 604 - RNA, 19 nt, Artificial Sequence
  source: /note="Description of Artificial Sequence: Synthetic oligonucleotide"
gcaagagacuguuuuguga

SEQ ID NO: 605 - RNA, 19 nt, Artificial Sequence
  source: /note="Description of Artificial Sequence: Synthetic oligonucleotide"
ggaaaacaaucuuccguuu

SEQ ID NO: 606 - RNA, 19 nt, Artificial Sequence
  source: /note="Description of Artificial Sequence: Synthetic oligonucleotide"
aaacggaagauuguuuucc

SEQ ID NO: 607 - RNA, 19 nt, Artificial Sequence
  source: /note="Description of Artificial Sequence: Synthetic oligonucleotide"
gaaaacaaucuuccguuuc

SEQ ID NO: 608 - RNA, 19 nt, Artificial Sequence
  source: /note="Description of Artificial Sequence: Synthetic oligonucleotide"
gaaacggaagauuguuuuc

SEQ ID NO: 609 - RNA, 19 nt, Artificial Sequence
  source: /note="Description of Artificial Sequence: Synthetic oligonucleotide"
aaaacaaucuuccguuuca

SEQ ID NO: 610 - RNA, 19 nt, Artificial Sequence
  source: /note="Description of Artificial Sequence: Synthetic oligonucleotide"
ugaaacggaagauuguuuu

SEQ ID NO: 611 - RNA, 19 nt, Artificial Sequence
  source: /note="Description of Artificial Sequence: Synthetic oligonucleotide"
aaacaaucuuccguuucaa

SEQ ID NO: 612 - RNA, 19 nt, Artificial Sequence
  source: /note="Description of Artificial Sequence: Synthetic oligonucleotide"
uugaaacggaagauuguuu

SEQ ID NO: 613 - RNA, 19 nt, Artificial Sequence
  source: /note="Description of Artificial Sequence: Synthetic oligonucleotide"
aacaaucuuccguuucaau

SEQ ID NO: 614 - RNA, 19 nt, Artificial Sequence
  source: /note="Description of Artificial Sequence: Synthetic oligonucleotide"
auugaaacggaagauuguu

SEQ ID NO: 615 - RNA, 19 nt, Artificial Sequence
  source: /note="Description of Artificial Sequence: Synthetic oligonucleotide"
caaucuuccguuucaaugc

SEQ ID NO: 616 - RNA, 19 nt, Artificial Sequence
  source: /note="Description of Artificial Sequence: Synthetic oligonucleotide"
gcauugaaacggaagauug

SEQ ID NO: 617 - RNA, 19 nt, Artificial Sequence
  source: /note="Description of Artificial Sequence: Synthetic oligonucleotide"
ccugcuuuauauaugcuuu

SEQ ID NO: 618 - RNA, 19 nt, Artificial Sequence
  source: /note="Description of Artificial Sequence: Synthetic oligonucleotide"
aaagcauauauaaagcagg

SEQ ID NO: 619 - RNA, 19 nt, Artificial Sequence
  source: /note="Description of Artificial Sequence: Synthetic oligonucleotide"
cugcuuuauauaugcuuuc

SEQ ID NO: 620 - RNA, 19 nt, Artificial Sequence
  source: /note="Description of Artificial Sequence: Synthetic oligonucleotide"
gaaagcauauauaaagcag

SEQ ID NO: 621 - RNA, 19 nt, Artificial Sequence
  source: /note="Description of Artificial Sequence: Synthetic oligonucleotide"
uaugcuuucuccuuucagu

SEQ ID NO: 622 - RNA, 19 nt, Artificial Sequence
  source: /note="Description of Artificial Sequence: Synthetic oligonucleotide"
acugaaaggagaaagcaua

SEQ ID NO: 623 - RNA, 19 nt, Artificial Sequence
  source: /note="Description of Artificial Sequence: Synthetic oligonucleotide"
augcuuucuccuuucaguc

SEQ ID NO: 624 - RNA, 19 nt, Artificial Sequence
  source: /note="Description of Artificial Sequence: Synthetic oligonucleotide"
gacugaaaggagaaagcau

SEQ ID NO: 625 - RNA, 19 nt, Artificial Sequence
  source: /note="Description of Artificial Sequence: Synthetic oligonucleotide"
ugcuuucuccuuucagucc

SEQ ID NO: 626 - RNA, 19 nt, Artificial Sequence
  source: /note="Description of Artificial Sequence: Synthetic oligonucleotide"
ggacugaaaggagaaagca

SEQ ID NO: 627 - RNA, 19 nt, Artificial Sequence
  source: /note="Description of Artificial Sequence: Synthetic oligonucleotide"
cuuucuccuuucaguccuc

SEQ ID NO: 628 - RNA, 19 nt, Artificial Sequence
  source: /note="Description of Artificial Sequence: Synthetic oligonucleotide"
gaggacugaaaggagaaag

SEQ ID NO: 629 - RNA, 19 nt, Artificial Sequence
  source: /note="Description of Artificial Sequence: Synthetic oligonucleotide"
ucuccuuucaguccucuaa

SEQ ID NO: 630 - RNA, 19 nt, Artificial Sequence
  source: /note="Description of Artificial Sequence: Synthetic oligonucleotide"
uuagaggacugaaaggaga

SEQ ID NO: 631 - RNA, 19 nt, Artificial Sequence
  source: /note="Description of Artificial Sequence: Synthetic oligonucleotide"
cuccuuucaguccucuaag

SEQ ID NO: 632 - RNA, 19 nt, Artificial Sequence
  source: /note="Description of Artificial Sequence: Synthetic oligonucleotide"
cuuagaggacugaaaggag

SEQ ID NO: 633 - RNA, 19 nt, Artificial Sequence
  source: /note="Description of Artificial Sequence: Synthetic oligonucleotide"
uccuuucaguccucuaaga

SEQ ID NO: 634 - RNA, 19 nt, Artificial Sequence
  source: /note="Description of Artificial Sequence: Synthetic oligonucleotide"
ucuuagaggacugaaagga

SEQ ID NO: 635 - RNA, 19 nt, Artificial Sequence
  source: /note="Description of Artificial Sequence: Synthetic oligonucleotide"
ccuuucaguccucuaagaa

SEQ ID NO: 636 - RNA, 19 nt, Artificial Sequence
  source: /note="Description of Artificial Sequence: Synthetic oligonucleotide"
uucuuagaggacugaaagg

SEQ ID NO: 637 - RNA, 19 nt, Artificial Sequence
  source: /note="Description of Artificial Sequence: Synthetic oligonucleotide"
cuuucaguccucuaagaag

SEQ ID NO: 638 - RNA, 19 nt, Artificial Sequence
  source: /note="Description of Artificial Sequence: Synthetic oligonucleotide"
cuucuuagaggacugaaag

SEQ ID NO: 639 - RNA, 19 nt, Artificial Sequence
  source: /note="Description of Artificial Sequence: Synthetic oligonucleotide"
aguccucuaagaagaauau

SEQ ID NO: 640 - RNA, 19 nt, Artificial Sequence
  source: /note="Description of Artificial Sequence: Synthetic oligonucleotide"
auauucuucuuagaggacu

SEQ ID NO: 641 - RNA, 19 nt, Artificial Sequence
  source: /note="Description of Artificial Sequence: Synthetic oligonucleotide"
uccucuaagaagaauaucu

SEQ ID NO: 642 - RNA, 19 nt, Artificial Sequence
  source: /note="Description of Artificial Sequence: Synthetic oligonucleotide"
agauauucuucuuagagga

SEQ ID NO: 643 - RNA, 19 nt, Artificial Sequence
  source: /note="Description of Artificial Sequence: Synthetic oligonucleotide"
ccucuaagaagaauaucua

SEQ ID NO: 644 - RNA, 19 nt, Artificial Sequence
  source: /note="Description of Artificial Sequence: Synthetic oligonucleotide"
uagauauucuucuuagagg

SEQ ID NO: 645 - RNA, 19 nt, Artificial Sequence
  source: /note="Description of Artificial Sequence: Synthetic oligonucleotide"
cucuaagaagaauaucuau

SEQ ID NO: 646 - RNA, 19 nt, Artificial Sequence
  source: /note="Description of Artificial Sequence: Synthetic oligonucleotide"
auagauauucuucuuagag

SEQ ID NO: 647 - RNA, 19 nt, Artificial Sequence
  source: /note="Description of Artificial Sequence: Synthetic oligonucleotide"
auuuuaguacacuccuuau

SEQ ID NO: 648 - RNA, 19 nt, Artificial Sequence
  source: /note="Description of Artificial Sequence: Synthetic oligonucleotide"
auaaggaguguacuaaaau

SEQ ID NO: 649 - RNA, 19 nt, Artificial Sequence
  source: /note="Description of Artificial Sequence: Synthetic oligonucleotide"
uaguacacuccuuauucag

SEQ ID NO: 650 - RNA, 19 nt, Artificial Sequence
  source: /note="Description of Artificial Sequence: Synthetic oligonucleotide"
cugaauaaggaguguacua

SEQ ID NO: 651 - RNA, 19 nt, Artificial Sequence
  source: /note="Description of Artificial Sequence: Synthetic oligonucleotide"
aguacacuccuuauucagc

SEQ ID NO: 652 - RNA, 19 nt, Artificial Sequence
  source: /note="Description of Artificial Sequence: Synthetic oligonucleotide"
gcugaauaaggaguguacu

SEQ ID NO: 653 - RNA, 19 nt, Artificial Sequence
  source: /note="Description of Artificial Sequence: Synthetic oligonucleotide"
ccuuauucagcaugcucau

SEQ ID NO: 654 - RNA, 19 nt, Artificial Sequence
  source: /note="Description of Artificial Sequence: Synthetic oligonucleotide"
augagcaugcugaauaagg

SEQ ID NO: 655 - RNA, 19 nt, Artificial Sequence
  source: /note="Description of Artificial Sequence: Synthetic oligonucleotide"
ucaucaugugcacuauucu

SEQ ID NO: 656 - RNA, 19 nt, Artificial Sequence
  source: /note="Description of Artificial Sequence: Synthetic oligonucleotide"
agaauagugcacaugauga

SEQ ID NO: 657 - RNA, 19 nt, Artificial Sequence
  source: /note="Description of Artificial Sequence: Synthetic oligonucleotide"
caucaugugcacuauucug

SEQ ID NO: 658 - RNA, 19 nt, Artificial Sequence
  source: /note="Description of Artificial Sequence: Synthetic oligonucleotide"
cagaauagugcacaugaug

SEQ ID NO: 659 - RNA, 19 nt, Artificial Sequence
  source: /note="Description of Artificial Sequence: Synthetic oligonucleotide"
ugucgaguacacuuuuacu

SEQ ID NO: 660 - RNA, 19 nt, Artificial Sequence
  source: /note="Description of Artificial Sequence: Synthetic oligonucleotide"
aguaaaaguguacucgaca

SEQ ID NO: 661 - RNA, 19 nt, Artificial Sequence
  source: /note="Description of Artificial Sequence: Synthetic oligonucleotide"
gucgaguacacuuuuacug

SEQ ID NO: 662 - RNA, 19 nt, Artificial Sequence
  source: /note="Description of Artificial Sequence: Synthetic oligonucleotide"
caguaaaaguguacucgac

SEQ ID NO: 663 - RNA, 19 nt, Artificial Sequence
  source: /note="Description of Artificial Sequence: Synthetic oligonucleotide"
cuucuguguaggagaauuc

SEQ ID NO: 664 - RNA, 19 nt, Artificial Sequence
  source: /note="Description of Artificial Sequence: Synthetic oligonucleotide"
gaauucuccuacacagaag

SEQ ID NO: 665 - RNA, 19 nt, Artificial Sequence
  source: /note="Description of Artificial Sequence: Synthetic oligonucleotide"
uaggagaauucacuuuucu

SEQ ID NO: 666 - RNA, 19 nt, Artificial Sequence
  source: /note="Description of Artificial Sequence: Synthetic oligonucleotide"
agaaaagugaauucuccua

SEQ ID NO: 667 - RNA, 19 nt, Artificial Sequence
  source: /note="Description of Artificial Sequence: Synthetic oligonucleotide"
aggagaauucacuuuucuu

SEQ ID NO: 668 - RNA, 19 nt, Artificial Sequence
  source: /note="Description of Artificial Sequence: Synthetic oligonucleotide"
aagaaaagugaauucuccu

SEQ ID NO: 669 - RNA, 19 nt, Artificial Sequence
  source: /note="Description of Artificial Sequence: Synthetic oligonucleotide"
ggagaauucacuuuucuuc

SEQ ID NO: 670 - RNA, 19 nt, Artificial Sequence
  source: /note="Description of Artificial Sequence: Synthetic oligonucleotide"
gaagaaaagugaauucucc

SEQ ID NO: 671 - RNA, 19 nt, Artificial Sequence
  source: /note="Description of Artificial Sequence: Synthetic oligonucleotide"
ggcaauguuucagcucuuc

SEQ ID NO: 672 - RNA, 19 nt, Artificial Sequence
  source: /note="Description of Artificial Sequence: Synthetic oligonucleotide"
gaagagcugaaacauugcc

SEQ ID NO: 673 - RNA, 19 nt, Artificial Sequence
  source: /note="Description of Artificial Sequence: Synthetic oligonucleotide"
aauguuucagcucuucgaa

SEQ ID NO: 674 - RNA, 19 nt, Artificial Sequence
  source: /note="Description of Artificial Sequence: Synthetic oligonucleotide"
uucgaagagcugaaacauu

SEQ ID NO: 675 - RNA, 19 nt, Artificial Sequence
  source: /note="Description of Artificial Sequence: Synthetic oligonucleotide"
guuucagcucuucgaacuu

SEQ ID NO: 676 - RNA, 19 nt, Artificial Sequence
  source: /note="Description of Artificial Sequence: Synthetic oligonucleotide"
aaguucgaagagcugaaac

SEQ ID NO: 677 - RNA, 19 nt, Artificial Sequence
  source: /note="Description of Artificial Sequence: Synthetic oligonucleotide"
ucagcucuucgaacuuuca

SEQ ID NO: 678 - RNA, 19 nt, Artificial Sequence
  source: /note="Description of Artificial Sequence: Synthetic oligonucleotide"
ugaaaguucgaagagcuga

SEQ ID NO: 679 - RNA, 19 nt, Artificial Sequence
  source: /note="Description of Artificial Sequence: Synthetic oligonucleotide"
agcucuucgaacuuucaga

SEQ ID NO: 680 - RNA, 19 nt, Artificial Sequence
  source: /note="Description of Artificial Sequence: Synthetic oligonucleotide"
cucagacagaacacaguca

SEQ ID NO: 681 - RNA, 19 nt, Artificial Sequence
  source: /note="Description of Artificial Sequence: Synthetic oligonucleotide"
gacuguguucugucugagu

SEQ ID NO: 682 - RNA, 19 nt, Artificial Sequence
  source: /note="Description of Artificial Sequence: Synthetic oligonucleotide"
acucagacagaacacaguc

SEQ ID NO: 683 - RNA, 19 nt, Artificial Sequence
  source: /note="Description of Artificial Sequence: Synthetic oligonucleotide"
acuguguucugucugagug

SEQ ID NO: 684 - RNA, 19 nt, Artificial Sequence
  source: /note="Description of Artificial Sequence: Synthetic oligonucleotide"
cacucagacagaacacagu

SEQ ID NO: 685 - RNA, 19 nt, Artificial Sequence
  source: /note="Description of Artificial Sequence: Synthetic oligonucleotide"
cuguguucugucugagugu

SEQ ID NO: 686 - RNA, 19 nt, Artificial Sequence
  source: /note="Description of Artificial Sequence: Synthetic oligonucleotide"
acacucagacagaacacag

SEQ ID NO: 687 - RNA, 19 nt, Artificial Sequence
  source: /note="Description of Artificial Sequence: Synthetic oligonucleotide"
uguguucugucugagugug

SEQ ID NO: 688 - RNA, 19 nt, Artificial Sequence
  source: /note="Description of Artificial Sequence: Synthetic oligonucleotide"
cacacucagacagaacaca

SEQ ID NO: 689 - RNA, 19 nt, Artificial Sequence
  source: /note="Description of Artificial Sequence: Synthetic oligonucleotide"
uguucugucugaguguguu

SEQ ID NO: 690 - RNA, 19 nt, Artificial Sequence
  source: /note="Description of Artificial Sequence: Synthetic oligonucleotide"
aacacacucagacagaaca

SEQ ID NO: 691 - RNA, 19 nt, Artificial Sequence
  source: /note="Description of Artificial Sequence: Synthetic oligonucleotide"
guucugucugaguguguuu

SEQ ID NO: 692 - RNA, 19 nt, Artificial Sequence
  source: /note="Description of Artificial Sequence: Synthetic oligonucleotide"
aaacacacucagacagaac

SEQ ID NO: 693 - RNA, 19 nt, Artificial Sequence
  source: /note="Description of Artificial Sequence: Synthetic oligonucleotide"
uucugucugaguguguuug

SEQ ID NO: 694 - RNA, 19 nt, Artificial Sequence
  source: /note="Description of Artificial Sequence: Synthetic oligonucleotide"
caaacacacucagacagaa

SEQ ID NO: 695 - RNA, 19 nt, Artificial Sequence
  source: /note="Description of Artificial Sequence: Synthetic oligonucleotide"
ucugucugaguguguuugc

SEQ ID NO: 696 - RNA, 19 nt, Artificial Sequence
  source: /note="Description of Artificial Sequence: Synthetic oligonucleotide"
gcaaacacacucagacaga

SEQ ID NO: 697 - RNA, 19 nt, Artificial Sequence
  source: /note="Description of Artificial Sequence: Synthetic oligonucleotide"
ugcucuccuuugugguuuc

SEQ ID NO: 698 - DNA, 19 bp, Artificial Sequence
  source: /note="Description of Artificial Sequence: Synthetic oligonucleotide"
gaaaccacaaaggagagca

SEQ ID NO: 699 - RNA, 19 nt, Artificial Sequence
  source: /note="Description of Artificial Sequence: Synthetic oligonucleotide"
cucuccuuugugguuucag

SEQ ID NO: 700 - RNA, 19 nt, Artificial Sequence
  source: /note="Description of Artificial Sequence: Synthetic oligonucleotide"
cugaaaccacaaaggagag

SEQ ID NO: 701 - RNA, 19 nt, Artificial Sequence
  source: /note="Description of Artificial Sequence: Synthetic oligonucleotide"
ucuccuuugugguuucagc

SEQ ID NO: 702 - RNA, 19 nt, Artificial Sequence
  source: /note="Description of Artificial Sequence: Synthetic oligonucleotide"
gcugaaaccacaaaggaga

SEQ ID NO: 703 - RNA, 19 nt, Artificial Sequence
  source: /note="Description of Artificial Sequence: Synthetic oligonucleotide"
cuccuuugugguuucagca

SEQ ID NO: 704 - RNA, 19 nt, Artificial Sequence
  source: /note="Description of Artificial Sequence: Synthetic oligonucleotide"
ugcugaaaccacaaaggag

SEQ ID NO: 705 - RNA, 19 nt, Artificial Sequence
  source: /note="Description of Artificial Sequence: Synthetic oligonucleotide"
cgagcuuugacacuuucag

SEQ ID NO: 706 - RNA, 19 nt, Artificial Sequence
  source: /note="Description of Artificial Sequence: Synthetic oligonucleotide"
cugaaagugucaaagcucg

SEQ ID NO: 707 - RNA, 19 nt, Artificial Sequence
  source: /note="Description of Artificial Sequence: Synthetic oligonucleotide"
acaugaucuucuuugucgu

SEQ ID NO: 708 - RNA, 19 nt, Artificial Sequence
  source: /note="Description of Artificial Sequence: Synthetic oligonucleotide"
acgacaaagaagaucaugu

SEQ ID NO: 709 - RNA, 19 nt, Artificial Sequence
  source: /note="Description of Artificial Sequence: Synthetic oligonucleotide"
caugaucuucuuugucgua

SEQ ID NO: 710 - RNA, 19 nt, Artificial Sequence
  source: /note="Description of Artificial Sequence: Synthetic oligonucleotide"
uacgacaaagaagaucaug

SEQ ID NO: 711 - RNA, 19 nt, Artificial Sequence
  source: /note="Description of Artificial Sequence: Synthetic oligonucleotide"
gaucuucuuugucguagug

SEQ ID NO: 712 - RNA, 19 nt, Artificial Sequence
  source: /note="Description of Artificial Sequence: Synthetic oligonucleotide"
cacuacgacaaagaagauc

SEQ ID NO: 713 - RNA, 19 nt, Artificial Sequence
  source: /note="Description of Artificial Sequence: Synthetic oligonucleotide"
ucuucuuugucguagugau

SEQ ID NO: 714 - RNA, 19 nt, Artificial Sequence
  source: /note="Description of Artificial Sequence: Synthetic oligonucleotide"
aucacuacgacaaagaaga

SEQ ID NO: 715 - RNA, 19 nt, Artificial Sequence
  source: /note="Description of Artificial Sequence: Synthetic oligonucleotide"
cuucuuugucguagugauu

SEQ ID NO: 716 - RNA, 19 nt, Artificial Sequence
  source: /note="Description of Artificial Sequence: Synthetic oligonucleotide"
aaucacuacgacaaagaag

SEQ ID NO: 717 - RNA, 19 nt, Artificial Sequence
  source: /note="Description of Artificial Sequence: Synthetic oligonucleotide"
uugucguagugauuuuccu

SEQ ID NO: 718 - RNA, 19 nt, Artificial Sequence
  source: /note="Description of Artificial Sequence: Synthetic oligonucleotide"
aggaaaaucacuacgacaa

SEQ ID NO: 719 - RNA, 19 nt, Artificial Sequence
  source: /note="Description of Artificial Sequence: Synthetic oligonucleotide"
gcuccuuuuaucuaauaaa

SEQ ID NO: 720 - RNA, 19 nt, Artificial Sequence
  source: /note="Description of Artificial Sequence: Synthetic oligonucleotide"
uuuauuagauaaaaggagc

SEQ ID NO: 721 - RNA, 19 nt, Artificial Sequence
  source: /note="Description of Artificial Sequence: Synthetic oligonucleotide"
cuccuuuuaucuaauaaac

SEQ ID NO: 722 - RNA, 19 nt, Artificial Sequence
  source: /note="Description of Artificial Sequence: Synthetic oligonucleotide"
guuuauuagauaaaaggag

SEQ ID NO: 723 - RNA, 19 nt, Artificial Sequence
  source: /note="Description of Artificial Sequence: Synthetic oligonucleotide"
ccucucagagaguucuucu

SEQ ID NO: 724 - RNA, 19 nt, Artificial Sequence
  source: /note="Description of Artificial Sequence: Synthetic oligonucleotide"
agaagaacucucugagagg

SEQ ID NO: 725 - RNA, 19 nt, Artificial Sequence
  source: /note="Description of Artificial Sequence: Synthetic oligonucleotide"
cucucagagaguucuucug

SEQ ID NO: 726 - RNA, 19 nt, Artificial Sequence
  source: /note="Description of Artificial Sequence: Synthetic oligonucleotide"
cagaagaacucucugagag

SEQ ID NO: 727 - RNA, 19 nt, Artificial Sequence
  source: /note="Description of Artificial Sequence: Synthetic oligonucleotide"
ucucagagaguucuucuga

SEQ ID NO: 728 - RNA, 19 nt, Artificial Sequence
  source: /note="Description of Artificial Sequence: Synthetic oligonucleotide"
ucagaagaacucucugaga

SEQ ID NO: 729 - RNA, 19 nt, Artificial Sequence
  source: /note="Description of Artificial Sequence: Synthetic oligonucleotide"
cucagagaguucuucugaa

SEQ ID NO: 730 - RNA, 19 nt, Artificial Sequence
  source: /note="Description of Artificial Sequence: Synthetic oligonucleotide"
uucagaagaacucucugag

SEQ ID NO: 731 - RNA, 19 nt, Artificial Sequence
  source: /note="Description of Artificial Sequence: Synthetic oligonucleotide"
ucagagaguucuucugaaa

SEQ ID NO: 732 - RNA, 19 nt, Artificial Sequence
  source: /note="Description of Artificial Sequence: Synthetic oligonucleotide"
uuucagaagaacucucuga

SEQ ID NO: 733 - RNA, 19 nt, Artificial Sequence
  source: /note="Description of Artificial Sequence: Synthetic oligonucleotide"
cagagaguucuucugaaac

SEQ ID NO: 734 - RNA, 19 nt, Artificial Sequence
  source: /note="Description of Artificial Sequence: Synthetic oligonucleotide"
guuucagaagaacucucug

SEQ ID NO: 735 - RNA, 19 nt, Artificial Sequence
  source: /note="Description of Artificial Sequence: Synthetic oligonucleotide"
gagaguucuucugaaacau

SEQ ID NO: 736 - RNA, 19 nt, Artificial Sequence
  source: /note="Description of Artificial Sequence: Synthetic oligonucleotide"
auguuucagaagaacucuc

SEQ ID NO: 737 - RNA, 19 nt, Artificial Sequence
  source: /note="Description of Artificial Sequence: Synthetic oligonucleotide"
agaguucuucugaaacauc

SEQ ID NO: 738 - RNA, 19 nt, Artificial Sequence
  source: /note="Description of Artificial Sequence: Synthetic oligonucleotide"
gauguuucagaagaacucu

SEQ ID NO: 739 - RNA, 19 nt, Artificial Sequence
  source: /note="Description of Artificial Sequence: Synthetic oligonucleotide"
gaguucuucugaaacaucc

SEQ ID NO: 740 - RNA, 19 nt, Artificial Sequence
  source: /note="Description of Artificial Sequence: Synthetic oligonucleotide"
ggauguuucagaagaacuc

SEQ ID NO: 741 - RNA, 19 nt, Artificial Sequence
  source: /note="Description of Artificial Sequence: Synthetic oligonucleotide"
aguucuucugaaacaucca

SEQ ID NO: 742 - RNA, 19 nt, Artificial Sequence
  source: /note="Description of Artificial Sequence: Synthetic oligonucleotide"
uggauguuucagaagaacu

SEQ ID NO: 743 - RNA, 19 nt, Artificial Sequence
  source: /note="Description of Artificial Sequence: Synthetic oligonucleotide"
guucuucugaaacauccaa

SEQ ID NO: 744 - RNA, 19 nt, Artificial Sequence
  source: /note="Description of Artificial Sequence: Synthetic oligonucleotide"
uuggauguuucagaagaac

SEQ ID NO: 745 - RNA, 19 nt, Artificial Sequence
  source: /note="Description of Artificial Sequence: Synthetic oligonucleotide"
ucuucugaaacauccaaac

SEQ ID NO: 746 - RNA, 19 nt, Artificial Sequence
  source: /note="Description of Artificial Sequence: Synthetic oligonucleotide"
guuuggauguuucagaaga

SEQ ID NO: 747 - RNA, 19 nt, Artificial Sequence
  source: /note="Description of Artificial Sequence: Synthetic oligonucleotide"
cuucugaaacauccaaacu

SEQ ID NO: 748 - RNA, 19 nt, Artificial Sequence
  source: /note="Description of Artificial Sequence: Synthetic oligonucleotide"
aguuuggauguuucagaag

SEQ ID NO: 749 - RNA, 19 nt, Artificial Sequence
  source: /note="Description of Artificial Sequence: Synthetic oligonucleotide"
ucugaaacauccaaacuga

SEQ ID NO: 750 - RNA, 19 nt, Artificial Sequence
  source: /note="Description of Artificial Sequence: Synthetic oligonucleotide"
ucaguuuggauguuucaga

SEQ ID NO: 751 - RNA, 19 nt, Artificial Sequence
  source: /note="Description of Artificial Sequence: Synthetic oligonucleotide"
uccaaacugagcucuaaaa

SEQ ID NO: 752 - RNA, 19 nt, Artificial Sequence
  source: /note="Description of Artificial Sequence: Synthetic oligonucleotide"
uuuuagagcucaguuugga

SEQ ID NO: 753 - RNA, 19 nt, Artificial Sequence
  source: /note="Description of Artificial Sequence: Synthetic oligonucleotide"
aggcguuguaguuccuauc

SEQ ID NO: 754 - RNA, 19 nt, Artificial Sequence
  source: /note="Description of Artificial Sequence: Synthetic oligonucleotide"
gauaggaacuacaacgccu

SEQ ID NO: 755 - RNA, 19 nt, Artificial Sequence
  source: /note="Description of Artificial Sequence: Synthetic oligonucleotide"
gcguuguaguuccuaucuc

SEQ ID NO: 756 - RNA, 19 nt, Artificial Sequence
  source: /note="Description of Artificial Sequence: Synthetic oligonucleotide"
gagauaggaacuacaacgc

SEQ ID NO: 757 - RNA, 19 nt, Artificial Sequence
  source: /note="Description of Artificial Sequence: Synthetic oligonucleotide"
cguuguaguuccuaucucc

SEQ ID NO: 758 - RNA, 19 nt, Artificial Sequence
  source: /note="Description of Artificial Sequence: Synthetic oligonucleotide"
ggagauaggaacuacaacg

SEQ ID NO: 759 - RNA, 19 nt, Artificial Sequence
  source: /note="Description of Artificial Sequence: Synthetic oligonucleotide"
guuguaguuccuaucuccu

SEQ ID NO: 760 - RNA, 19 nt, Artificial Sequence
  source: /note="Description of Artificial Sequence: Synthetic oligonucleotide"
aggagauaggaacuacaac

SEQ ID NO: 761 - RNA, 19 nt, Artificial Sequence
  source: /note="Description of Artificial Sequence: Synthetic oligonucleotide"
uuguaguuccuaucuccuu

SEQ ID NO: 762 - RNA, 19 nt, Artificial Sequence
  source: /note="Description of Artificial Sequence: Synthetic oligonucleotide"
aaggagauaggaacuacaa

SEQ ID NO: 763 - RNA, 19 nt, Artificial Sequence
  source: /note="Description of Artificial Sequence: Synthetic oligonucleotide"
uguaguuccuaucuccuuu

SEQ ID NO: 764 - RNA, 19 nt, Artificial Sequence
  source: /note="Description of Artificial Sequence: Synthetic oligonucleotide"
aaaggagauaggaacuaca

SEQ ID NO: 765 - RNA, 19 nt, Artificial Sequence
  source: /note="Description of Artificial Sequence: Synthetic oligonucleotide"
guaguuccuaucuccuuuc

SEQ ID NO: 766 - RNA, 19 nt, Artificial Sequence
  source: /note="Description of Artificial Sequence: Synthetic oligonucleotide"
gaaaggagauaggaacuac

SEQ ID NO: 767 - RNA, 19 nt, Artificial Sequence
  source: /note="Description of Artificial Sequence: Synthetic oligonucleotide"
uaguuccuaucuccuuuca

SEQ ID NO: 768 - RNA, 19 nt, Artificial Sequence
  source: /note="Description of Artificial Sequence: Synthetic oligonucleotide"
ugaaaggagauaggaacua

SEQ ID NO: 769 - RNA, 19 nt, Artificial Sequence
  source: /note="Description of Artificial Sequence: Synthetic oligonucleotide"
aguuccuaucuccuuucag

SEQ ID NO: 770 - RNA, 19 nt, Artificial Sequence
  source: /note="Description of Artificial Sequence: Synthetic oligonucleotide"
cugaaaggagauaggaacu

SEQ ID NO: 771 - RNA, 19 nt, Artificial Sequence
  source: /note="Description of Artificial Sequence: Synthetic oligonucleotide"
guuccuaucuccuuucaga

SEQ ID NO: 772 - RNA, 19 nt, Artificial Sequence
  source: /note="Description of Artificial Sequence: Synthetic oligonucleotide"
ucugaaaggagauaggaac

SEQ ID NO: 773 - RNA, 19 nt, Artificial Sequence
  source: /note="Description of Artificial Sequence: Synthetic oligonucleotide"
uuccuaucuccuuucagag

SEQ ID NO: 774 - RNA, 19 nt, Artificial Sequence
  source: /note="Description of Artificial Sequence: Synthetic oligonucleotide"
cucugaaaggagauaggaa

SEQ ID NO: 775 - RNA, 19 nt, Artificial Sequence
  source: /note="Description of Artificial Sequence: Synthetic oligonucleotide"
uccuaucuccuuucagagg

SEQ ID NO: 776 - RNA, 19 nt, Artificial Sequence
  source: /note="Description of Artificial Sequence: Synthetic oligonucleotide"
ccucugaaaggagauagga

SEQ ID NO: 777 - RNA, 19 nt, Artificial Sequence
  source: /note="Description of Artificial Sequence: Synthetic oligonucleotide"
ucuccuuucagaggauaug

SEQ ID NO: 778 - RNA, 19 nt, Artificial Sequence
  source: /note="Description of Artificial Sequence: Synthetic oligonucleotide"
cauauccucugaaaggaga

SEQ ID NO: 779 - RNA, 19 nt, Artificial Sequence
  source: /note="Description of Artificial Sequence: Synthetic oligonucleotide"
gcauauuaacaaacacugu

SEQ ID NO: 780 - RNA, 19 nt, Artificial Sequence
  source: /note="Description of Artificial Sequence: Synthetic oligonucleotide"
acaguguuuguuaauaugc

SEQ ID NO: 781 - RNA, 19 nt, Artificial Sequence
  source: /note="Description of Artificial Sequence: Synthetic oligonucleotide"
cuugaucuggaauugcucu

SEQ ID NO: 782 - RNA, 19 nt, Artificial Sequence
  source: /note="Description of Artificial Sequence: Synthetic oligonucleotide"
agagcaauuccagaucaag

SEQ ID NO: 783 - RNA, 19 nt, Artificial Sequence
  source: /note="Description of Artificial Sequence: Synthetic oligonucleotide"
cucuccauauuggauaaaa

SEQ ID NO: 784 - RNA, 19 nt, Artificial Sequence
  source: /note="Description of Artificial Sequence: Synthetic oligonucleotide"
uuuuauccaauauggagag

SEQ ID NO: 785 - RNA, 19 nt, Artificial Sequence
  source: /note="Description of Artificial Sequence: Synthetic oligonucleotide"
ucuccauauuggauaaaau

SEQ ID NO: 786 - RNA, 19 nt, Artificial Sequence
  source: /note="Description of Artificial Sequence: Synthetic oligonucleotide"
auuuuauccaauauggaga

SEQ ID NO: 787 - RNA, 19 nt, Artificial Sequence
  source: /note="Description of Artificial Sequence: Synthetic oligonucleotide"
cuccauauuggauaaaauu

SEQ ID NO: 788 - RNA, 19 nt, Artificial Sequence
  source: /note="Description of Artificial Sequence: Synthetic oligonucleotide"
aauuuuauccaauauggag

SEQ ID NO: 789 - RNA, 19 nt, Artificial Sequence
  source: /note="Description of Artificial Sequence: Synthetic oligonucleotide"
gaucuugcaauuaccauuu

SEQ ID NO: 790 - RNA, 19 nt, Artificial Sequence
  source: /note="Description of Artificial Sequence: Synthetic oligonucleotide"
aaaugguaauugcaagauc

SEQ ID NO: 791 - RNA, 19 nt, Artificial Sequence
  source: /note="Description of Artificial Sequence: Synthetic oligonucleotide"
uuggucuuuacuggaaucu

SEQ ID NO: 792 - RNA, 19 nt, Artificial Sequence
  source: /note="Description of Artificial Sequence: Synthetic oligonucleotide"
agauuccaguaaagaccaa

SEQ ID NO: 793 - RNA, 19 nt, Artificial Sequence
  source: /note="Description of Artificial Sequence: Synthetic oligonucleotide"
ggucuuuacuggaaucuuu

SEQ ID NO: 794 - RNA, 19 nt, Artificial Sequence
  source: /note="Description of Artificial Sequence: Synthetic oligonucleotide"
aaagauuccaguaaagacc

SEQ ID NO: 795 - RNA, 19 nt, Artificial Sequence
  source: /note="Description of Artificial Sequence: Synthetic oligonucleotide"
gucuuuacuggaaucuuug

SEQ ID NO: 796 - RNA, 19 nt, Artificial Sequence
  source: /note="Description of Artificial Sequence: Synthetic oligonucleotide"
caaagauuccaguaaagac

SEQ ID NO: 797 - RNA, 19 nt, Artificial Sequence
  source: /note="Description of Artificial Sequence: Synthetic oligonucleotide"
gccuuauugugacuuuaag

SEQ ID NO: 798 - RNA, 19 nt, Artificial Sequence
  source: /note="Description of Artificial Sequence: Synthetic oligonucleotide"
cuuaaagucacaauaaggc

SEQ ID NO: 799 - RNA, 19 nt, Artificial Sequence
  source: /note="Description of Artificial Sequence: Synthetic oligonucleotide"
gcucuuucuagcagaugug

SEQ ID NO: 800 - RNA, 19 nt, Artificial Sequence
  source: /note="Description of Artificial Sequence: Synthetic oligonucleotide"
cacaucugcuagaaagagc

SEQ ID NO: 801 - RNA, 19 nt, Artificial Sequence
  source: /note="Description of Artificial Sequence: Synthetic oligonucleotide"
cucuuucuagcagaugugg

SEQ ID NO: 802 - RNA, 19 nt, Artificial Sequence
  source: /note="Description of Artificial Sequence: Synthetic oligonucleotide"
ccacaucugcuagaaagag

SEQ ID NO: 803 - RNA, 19 nt, Artificial Sequence
  source: /note="Description of Artificial Sequence: Synthetic oligonucleotide"
gucaguucugcgaucauuc

SEQ ID NO: 804 - RNA, 19 nt, Artificial Sequence
  source: /note="Description of Artificial Sequence: Synthetic oligonucleotide"
gaaugaucgcagaacugac

SEQ ID NO: 805 - RNA, 19 nt, Artificial Sequence
  source: /note="Description of Artificial Sequence: Synthetic oligonucleotide"
ucaguucugcgaucauuca

SEQ ID NO: 806 - RNA, 19 nt, Artificial Sequence
  source: /note="Description of Artificial Sequence: Synthetic oligonucleotide"
ugaaugaucgcagaacuga

SEQ ID NO: 807 - RNA, 19 nt, Artificial Sequence
  source: /note="Description of Artificial Sequence: Synthetic oligonucleotide"
agucuucaaguuggcaaaa

SEQ ID NO: 808 - RNA, 19 nt, Artificial Sequence
  source: /note="Description of Artificial Sequence: Synthetic oligonucleotide"
uuuugccaacuugaagacu

SEQ ID NO: 809 - RNA, 19 nt, Artificial Sequence
  source: /note="Description of Artificial Sequence: Synthetic oligonucleotide"
ucuucaaguuggcaaaauc

SEQ ID NO: 810 - RNA, 19 nt, Artificial Sequence
  source: /note="Description of Artificial Sequence: Synthetic oligonucleotide"
gauuuugccaacuugaaga

SEQ ID NO: 811 - RNA, 19 nt, Artificial Sequence
  source: /note="Description of Artificial Sequence: Synthetic oligonucleotide"
cuucaaguuggcaaaaucc

SEQ ID NO: 812 - RNA, 19 nt, Artificial Sequence
  source: /note="Description of Artificial Sequence: Synthetic oligonucleotide"
ggauuuugccaacuugaag

SEQ ID NO: 813 - RNA, 19 nt, Artificial Sequence
  source: /note="Description of Artificial Sequence: Synthetic oligonucleotide"
ccaucaucgucuucauuuu

SEQ ID NO: 814 - RNA, 19 nt, Artificial Sequence
  source: /note="Description of Artificial Sequence: Synthetic oligonucleotide"
aaaaugaagacgaugaugg

SEQ ID NO: 815 - RNA, 19 nt, Artificial Sequence
  source: /note="Description of Artificial Sequence: Synthetic oligonucleotide"
caucaucgucuucauuuuu

SEQ ID NO: 816 - RNA, 19 nt, Artificial Sequence
  source: /note="Description of Artificial Sequence: Synthetic oligonucleotide"
aaaaaugaagacgaugaug

SEQ ID NO: 817 - RNA, 19 nt, Artificial Sequence
  source: /note="Description of Artificial Sequence: Synthetic oligonucleotide"
gcacaugaacgacuucuuc

SEQ ID NO: 818 - RNA, 19 nt, Artificial Sequence
  source: /note="Description of Artificial Sequence: Synthetic oligonucleotide"
gaagaagucguucaugugc

SEQ ID NO: 819 - RNA, 19 nt, Artificial Sequence
  source: /note="Description of Artificial Sequence: Synthetic oligonucleotide"
cacaugaacgacuucuucc

SEQ ID NO: 820 - RNA, 19 nt, Artificial Sequence
  source: /note="Description of Artificial Sequence: Synthetic oligonucleotide"
ggaagaagucguucaugug

SEQ ID NO: 821 - RNA, 19 nt, Artificial Sequence
  source: /note="Description of Artificial Sequence: Synthetic oligonucleotide"
acaugaacgacuucuucca

SEQ ID NO: 822 - RNA, 19 nt, Artificial Sequence
  source: /note="Description of Artificial Sequence: Synthetic oligonucleotide"
uggaagaagucguucaugu

SEQ ID NO: 823 - RNA, 19 nt, Artificial Sequence
  source: /note="Description of Artificial Sequence: Synthetic oligonucleotide"
caugaacgacuucuuccac

SEQ ID NO: 824 - RNA, 19 nt, Artificial Sequence
  source: /note="Description of Artificial Sequence: Synthetic oligonucleotide"
guggaagaagucguucaug

SEQ ID NO: 825 - RNA, 19 nt, Artificial Sequence
  source: /note="Description of Artificial Sequence: Synthetic oligonucleotide"
ugaacgacuucuuccacuc

SEQ ID NO: 826 - RNA, 19 nt, Artificial Sequence
  source: /note="Description of Artificial Sequence: Synthetic oligonucleotide"
gaguggaagaagucguuca

SEQ ID NO: 827 - RNA, 19 nt, Artificial Sequence
  source: /note="Description of Artificial Sequence: Synthetic oligonucleotide"
cgacuucuuccacuccuuc

SEQ ID NO: 828 - RNA, 19 nt, Artificial Sequence
  source: /note="Description of Artificial Sequence: Synthetic oligonucleotide"
gaaggaguggaagaagucg

SEQ ID NO: 829 - RNA, 19 nt, Artificial Sequence
  source: /note="Description of Artificial Sequence: Synthetic oligonucleotide"
uccacuccuuccugauugu

SEQ ID NO: 830 - RNA, 19 nt, Artificial Sequence
  source: /note="Description of Artificial Sequence: Synthetic oligonucleotide"
acaaucaggaaggagugga

SEQ ID NO: 831 - RNA, 19 nt, Artificial Sequence
  source: /note="Description of Artificial Sequence: Synthetic oligonucleotide"
acuccuuccugauuguguu

SEQ ID NO: 832 - RNA, 19 nt, Artificial Sequence
  source: /note="Description of Artificial Sequence: Synthetic oligonucleotide"
aacacaaucaggaaggagu

SEQ ID NO: 833 - RNA, 19 nt, Artificial Sequence
  source: /note="Description of Artificial Sequence: Synthetic oligonucleotide"
cuccuuccugauuguguuc

SEQ ID NO: 834 - RNA, 19 nt, Artificial Sequence
  source: /note="Description of Artificial Sequence: Synthetic oligonucleotide"
gaacacaaucaggaaggag

SEQ ID NO: 835 - RNA, 19 nt, Artificial Sequence
  source: /note="Description of Artificial Sequence: Synthetic oligonucleotide"
uccuuccugauuguguucc

SEQ ID NO: 836 - RNA, 19 nt, Artificial Sequence
  source: /note="Description of Artificial Sequence: Synthetic oligonucleotide"
ggaacacaaucaggaagga

SEQ ID NO: 837 - RNA, 19 nt, Artificial Sequence
  source: /note="Description of Artificial Sequence: Synthetic oligonucleotide"
cuaugugccuuauuguuua

SEQ ID NO: 838 - RNA, 19 nt, Artificial Sequence
  source: /note="Description of Artificial Sequence: Synthetic oligonucleotide"
uaaacaauaaggcacauag

SEQ ID NO: 839 - RNA, 19 nt, Artificial Sequence
  source: /note="Description of Artificial Sequence: Synthetic oligonucleotide"
ugguccuaaaccuauuucu

SEQ ID NO: 840 - RNA, 19 nt, Artificial Sequence
  source: /note="Description of Artificial Sequence: Synthetic oligonucleotide"
agaaauagguuuaggacca

SEQ ID NO: 841 - RNA, 19 nt, Artificial Sequence
  source: /note="Description of Artificial Sequence: Synthetic oligonucleotide"
gguccuaaaccuauuucug

SEQ ID NO: 842 - RNA, 19 nt, Artificial Sequence
  source: /note="Description of Artificial Sequence: Synthetic oligonucleotide"
cagaaauagguuuaggacc

SEQ ID NO: 843 - RNA, 19 nt, Artificial Sequence
  source: /note="Description of Artificial Sequence: Synthetic oligonucleotide"
guccuaaaccuauuucugg

SEQ ID NO: 844 - RNA, 19 nt, Artificial Sequence
  source: /note="Description of Artificial Sequence: Synthetic oligonucleotide"
ccagaaauagguuuaggac

SEQ ID NO: 845 - RNA, 19 nt, Artificial Sequence
  source: /note="Description of Artificial Sequence: Synthetic oligonucleotide"
ccuuacgugaauuuauucu

SEQ ID NO: 846 - RNA, 19 nt, Artificial Sequence
  source: /note="Description of Artificial Sequence: Synthetic oligonucleotide"
agaauaaauucacguaagg

SEQ ID NO: 847 - RNA, 19 nt, Artificial Sequence
  source: /note="Description of Artificial Sequence: Synthetic oligonucleotide"
caaaggucacaauuuccuc

SEQ ID NO: 848 - RNA, 19 nt, Artificial Sequence
  source: /note="Description of Artificial Sequence: Synthetic oligonucleotide"
gaggaaauugugaccuuug

SEQ ID NO: 849 - RNA, 19 nt, Artificial Sequence
  source: /note="Description of Artificial Sequence: Synthetic oligonucleotide"
ucacaauuuccucaaggaa

SEQ ID NO: 850 - RNA, 19 nt, Artificial Sequence
  source: /note="Description of Artificial Sequence: Synthetic oligonucleotide"
uuccuugaggaaauuguga

SEQ ID NO: 851 - RNA, 19 nt, Artificial Sequence
  source: /note="Description of Artificial Sequence: Synthetic oligonucleotide"
ccucaaggaaaaagauaaa

SEQ ID NO: 852 - RNA, 19 nt, Artificial Sequence
  source: /note="Description of Artificial Sequence: Synthetic oligonucleotide"
uuuaucuuuuuccuugagg

SEQ ID NO: 853 - RNA, 19 nt, Artificial Sequence
  source: /note="Description of Artificial Sequence: Synthetic oligonucleotide"
gcuucauuguccucaugau

SEQ ID NO: 854 - RNA, 19 nt, Artificial Sequence
  source: /note="Description of Artificial Sequence: Synthetic oligonucleotide"
aucaugaggacaaugaagc

SEQ ID NO: 855 - RNA, 19 nt, Artificial Sequence
  source: /note="Description of Artificial Sequence: Synthetic oligonucleotide"
cuucauuguccucaugauc

SEQ ID NO: 856 - RNA, 19 nt, Artificial Sequence
  source: /note="Description of Artificial Sequence: Synthetic oligonucleotide"
gaucaugaggacaaugaag

SEQ ID NO: 857 - RNA, 19 nt, Artificial Sequence
  source: /note="Description of Artificial Sequence: Synthetic oligonucleotide"
ugcagacaagaucuucacu

SEQ ID NO: 858 - RNA, 19 nt, Artificial Sequence
  source: /note="Description of Artificial Sequence: Synthetic oligonucleotide"
agugaagaucuugucugca

SEQ ID NO: 859 - RNA, 19 nt, Artificial Sequence
  source: /note="Description of Artificial Sequence: Synthetic oligonucleotide"
cagacaagaucuucacuua

SEQ ID NO: 860 - RNA, 19 nt, Artificial Sequence
  source: /note="Description of Artificial Sequence: Synthetic oligonucleotide"
uaagugaagaucuugucug

SEQ ID NO: 861 - RNA, 19 nt, Artificial Sequence
  source: /note="Description of Artificial Sequence: Synthetic oligonucleotide"
agacaagaucuucacuuac

SEQ ID NO: 862 - RNA, 19 nt, Artificial Sequence
  source: /note="Description of Artificial Sequence: Synthetic oligonucleotide"
guaagugaagaucuugucu

SEQ ID NO: 863 - RNA, 19 nt, Artificial Sequence
  source: /note="Description of Artificial Sequence: Synthetic oligonucleotide"
gacaagaucuucacuuaca

SEQ ID NO: 864 - RNA, 19 nt, Artificial Sequence
  source: /note="Description of Artificial Sequence: Synthetic oligonucleotide"
uguaagugaagaucuuguc

SEQ ID NO: 865 - RNA, 19 nt, Artificial Sequence
  source: /note="Description of Artificial Sequence: Synthetic oligonucleotide"
acaagaucuucacuuacau

SEQ ID NO: 866 - RNA, 19 nt, Artificial Sequence
  source: /note="Description of Artificial Sequence: Synthetic oligonucleotide"
auguaagugaagaucuugu

SEQ ID NO: 867 - RNA, 19 nt, Artificial Sequence
  source: /note="Description of Artificial Sequence: Synthetic oligonucleotide"
caagaucuucacuuacauc

SEQ ID NO: 868 - RNA, 19 nt, Artificial Sequence
  source: /note="Description of Artificial Sequence: Synthetic oligonucleotide"
gauguaagugaagaucuug

SEQ ID NO: 869 - RNA, 19 nt, Artificial Sequence
  source: /note="Description of Artificial Sequence: Synthetic oligonucleotide"
agaucuucacuuacaucuu

SEQ ID NO: 870 - RNA, 19 nt, Artificial Sequence
  source: /note="Description of Artificial Sequence: Synthetic oligonucleotide"
aagauguaagugaagaucu

SEQ ID NO: 871 - RNA, 19 nt, Artificial Sequence
  source: /note="Description of Artificial Sequence: Synthetic oligonucleotide"
gaucuucacuuacaucuuc

SEQ ID NO: 872 - RNA, 19 nt, Artificial Sequence
  source: /note="Description of Artificial Sequence: Synthetic oligonucleotide"
gaagauguaagugaagauc

SEQ ID NO: 873 - RNA, 19 nt, Artificial Sequence
  source: /note="Description of Artificial Sequence: Synthetic oligonucleotide"
ucuucacuuacaucuucau

SEQ ID NO: 874 - RNA, 19 nt, Artificial Sequence
  source: /note="Description of Artificial Sequence: Synthetic oligonucleotide"
augaagauguaagugaaga

SEQ ID NO: 875 - RNA, 19 nt, Artificial Sequence
  source: /note="Description of Artificial Sequence: Synthetic oligonucleotide"
cuucacuuacaucuucauu

SEQ ID NO: 876 - RNA, 19 nt, Artificial Sequence
  source: /note="Description of Artificial Sequence: Synthetic oligonucleotide"
aaugaagauguaagugaag

SEQ ID NO: 877 - RNA, 19 nt, Artificial Sequence
  source: /note="Description of Artificial Sequence: Synthetic oligonucleotide"
uucacuuacaucuucauuc

SEQ ID NO: 878 - RNA, 19 nt, Artificial Sequence
  source: /note="Description of Artificial Sequence: Synthetic oligonucleotide"
gaaugaagauguaagugaa

SEQ ID NO: 879 - RNA, 19 nt, Artificial Sequence
  source: /note="Description of Artificial Sequence: Synthetic oligonucleotide"
ucacuuacaucuucauucu

SEQ ID NO: 880 - RNA, 19 nt, Artificial Sequence
  source: /note="Description of Artificial Sequence: Synthetic oligonucleotide"
agaaugaagauguaaguga

SEQ ID NO: 881 - RNA, 19 nt, Artificial Sequence
  source: /note="Description of Artificial Sequence: Synthetic oligonucleotide"
cacuuacaucuucauucug

SEQ ID NO: 882 - RNA, 19 nt, Artificial Sequence
  source: /note="Description of Artificial Sequence: Synthetic oligonucleotide"
cagaaugaagauguaagug

SEQ ID NO: 883 - RNA, 19 nt, Artificial Sequence
  source: /note="Description of Artificial Sequence: Synthetic oligonucleotide"
cuuacaucuucauucugga

SEQ ID NO: 884 - RNA, 19 nt, Artificial Sequence
  source: /note="Description of Artificial Sequence: Synthetic oligonucleotide"
uccagaaugaagauguaag

SEQ ID NO: 885 - RNA, 19 nt, Artificial Sequence
  source: /note="Description of Artificial Sequence: Synthetic oligonucleotide"
acaucuucauucuggaaau

SEQ ID NO: 886 - RNA, 19 nt, Artificial Sequence
  source: /note="Description of Artificial Sequence: Synthetic oligonucleotide"
auuuccagaaugaagaugu

SEQ ID NO: 887 - RNA, 19 nt, Artificial Sequence
  source: /note="Description of Artificial Sequence: Synthetic oligonucleotide"
caucuucauucuggaaaug

SEQ ID NO: 888 - RNA, 19 nt, Artificial Sequence
  source: /note="Description of Artificial Sequence: Synthetic oligonucleotide"
cauuuccagaaugaagaug

SEQ ID NO: 889 - RNA, 19 nt, Artificial Sequence
  source: /note="Description of Artificial Sequence: Synthetic oligonucleotide"
ucuucauucuggaaaugcu

SEQ ID NO: 890 - RNA, 19 nt, Artificial Sequence
  source: /note="Description of Artificial Sequence: Synthetic oligonucleotide"
agcauuuccagaaugaaga

SEQ ID NO: 891 - RNA, 19 nt, Artificial Sequence
  source: /note="Description of Artificial Sequence: Synthetic oligonucleotide"
cuucauucuggaaaugcuu

SEQ ID NO: 892 - RNA, 19 nt, Artificial Sequence
  source: /note="Description of Artificial Sequence: Synthetic oligonucleotide"
aagcauuuccagaaugaag

SEQ ID NO: 893 - RNA, 19 nt, Artificial Sequence
  source: /note="Description of Artificial Sequence: Synthetic oligonucleotide"
ucuggaaaugcuucuaaaa

SEQ ID NO: 894 - RNA, 19 nt, Artificial Sequence
  source: /note="Description of Artificial Sequence: Synthetic oligonucleotide"
uuuuagaagcauuuccaga

SEQ ID NO: 895 - RNA, 19 nt, Artificial Sequence
  source: /note="Description of Artificial Sequence: Synthetic oligonucleotide"
gcuggauuuccuaauuguu

SEQ ID NO: 896 - RNA, 19 nt, Artificial Sequence
  source: /note="Description of Artificial Sequence: Synthetic oligonucleotide"
aacaauuaggaaauccagc

SEQ ID NO: 897 - RNA, 19 nt, Artificial Sequence
  source: /note="Description of Artificial Sequence: Synthetic oligonucleotide"
cuggauuuccuaauuguug

SEQ ID NO: 898 - RNA, 19 nt, Artificial Sequence
  source: /note="Description of Artificial Sequence: Synthetic oligonucleotide"
caacaauuaggaaauccag

SEQ ID NO: 899 - RNA, 19 nt, Artificial Sequence
  source: /note="Description of Artificial Sequence: Synthetic oligonucleotide"
ccucuaagagccuuaucua

SEQ ID NO: 900 - RNA, 19 nt, Artificial Sequence
  source: /note="Description of Artificial Sequence: Synthetic oligonucleotide"
uagauaaggcucuuagagg

SEQ ID NO: 901 - RNA, 19 nt, Artificial Sequence
  source: /note="Description of Artificial Sequence: Synthetic oligonucleotide"
cucuaagagccuuaucuag

SEQ ID NO: 902 - RNA, 19 nt, Artificial Sequence
  source: /note="Description of Artificial Sequence: Synthetic oligonucleotide"
cuagauaaggcucuuagag

SEQ ID NO: 903 - RNA, 19 nt, Artificial Sequence
  source: /note="Description of Artificial Sequence: Synthetic oligonucleotide"
cuuccaucaugaaugugcu

SEQ ID NO: 904 - RNA, 19 nt, Artificial Sequence
  source: /note="Description of Artificial Sequence: Synthetic oligonucleotide"
agcacauucaugauggaag

SEQ ID NO: 905 - RNA, 19 nt, Artificial Sequence
  source: /note="Description of Artificial Sequence: Synthetic oligonucleotide"
uuuccugcaagucaaguuc

SEQ ID NO: 906 - RNA, 19 nt, Artificial Sequence
  source: /note="Description of Artificial Sequence: Synthetic oligonucleotide"
gaacuugacuugcaggaaa

SEQ ID NO: 907 - RNA, 19 nt, Artificial Sequence
  source: /note="Description of Artificial Sequence: Synthetic oligonucleotide"
cugcaagucaaguuccaaa

SEQ ID NO: 908 - RNA, 19 nt, Artificial Sequence
  source: /note="Description of Artificial Sequence: Synthetic oligonucleotide"
uuuggaacuugacuugcag

SEQ ID NO: 909 - RNA, 19 nt, Artificial Sequence
  source: /note="Description of Artificial Sequence: Synthetic oligonucleotide"
agucaaguuccaaaucguu

SEQ ID NO: 910 - RNA, 19 nt, Artificial Sequence
  source: /note="Description of Artificial Sequence: Synthetic oligonucleotide"
aacgauuuggaacuugacu

SEQ ID NO: 911 - RNA, 19 nt, Artificial Sequence
  source: /note="Description of Artificial Sequence: Synthetic oligonucleotide"
acuugguuaccuaucucug

SEQ ID NO: 912 - RNA, 19 nt, Artificial Sequence
  source: /note="Description of Artificial Sequence: Synthetic oligonucleotide"
cagagauagguaaccaagu

SEQ ID NO: 913 - RNA, 19 nt, Artificial Sequence
  source: /note="Description of Artificial Sequence: Synthetic oligonucleotide"
cuugguuaccuaucucugc

SEQ ID NO: 914 - RNA, 19 nt, Artificial Sequence
  source: /note="Description of Artificial Sequence: Synthetic oligonucleotide"
gcagagauagguaaccaag

SEQ ID NO: 915 - RNA, 19 nt, Artificial Sequence
  source: /note="Description of Artificial Sequence: Synthetic oligonucleotide"
gguuaccuaucucugcuuc

SEQ ID NO: 916 - RNA, 19 nt, Artificial Sequence
  source: /note="Description of Artificial Sequence: Synthetic oligonucleotide"
gaagcagagauagguaacc

SEQ ID NO: 917 - RNA, 19 nt, Artificial Sequence
  source: /note="Description of Artificial Sequence: Synthetic oligonucleotide"
guuaccuaucucugcuuca

SEQ ID NO: 918 - RNA, 19 nt, Artificial Sequence
  source: /note="Description of Artificial Sequence: Synthetic oligonucleotide"
ugaagcagagauagguaac

SEQ ID NO: 919 - RNA, 19 nt, Artificial Sequence
  source: /note="Description of Artificial Sequence: Synthetic oligonucleotide"
uuaccuaucucugcuucaa

SEQ ID NO: 920 - RNA, 19 nt, Artificial Sequence
  source: /note="Description of Artificial Sequence: Synthetic oligonucleotide"
uugaagcagagauagguaa

SEQ ID NO: 921 - RNA, 19 nt, Artificial Sequence
  source: /note="Description of Artificial Sequence: Synthetic oligonucleotide"
uaccuaucucugcuucaag

SEQ ID NO: 922 - RNA, 19 nt, Artificial Sequence
  source: /note="Description of Artificial Sequence: Synthetic oligonucleotide"
cuugaagcagagauaggua

SEQ ID NO: 923 - RNA, 19 nt, Artificial Sequence
  source: /note="Description of Artificial Sequence: Synthetic oligonucleotide"
accuaucucugcuucaagu

SEQ ID NO: 924 - RNA, 19 nt, Artificial Sequence
  source: /note="Description of Artificial Sequence: Synthetic oligonucleotide"
acuugaagcagagauaggu

SEQ ID NO: 925 - RNA, 19 nt, Artificial Sequence
  source: /note="Description of Artificial Sequence: Synthetic oligonucleotide"
ccuaucucugcuucaaguu

SEQ ID NO: 926 - RNA, 19 nt, Artificial Sequence
  source: /note="Description of Artificial Sequence: Synthetic oligonucleotide"
aacuugaagcagagauagg

SEQ ID NO: 927 - RNA, 19 nt, Artificial Sequence
  source: /note="Description of Artificial Sequence: Synthetic oligonucleotide"
cuaucucugcuucaaguug

SEQ ID NO: 928 - RNA, 19 nt, Artificial Sequence
  source: /note="Description of Artificial Sequence: Synthetic oligonucleotide"
caacuugaagcagagauag

SEQ ID NO: 929 - RNA, 19 nt, Artificial Sequence
  source: /note="Description of Artificial Sequence: Synthetic oligonucleotide"
aucucugcuucaaguugca

SEQ ID NO: 930 - RNA, 19 nt, Artificial Sequence
  source: /note="Description of Artificial Sequence: Synthetic oligonucleotide"
ugcaacuugaagcagagau

SEQ ID NO: 931 - RNA, 19 nt, Artificial Sequence
  source: /note="Description of Artificial Sequence: Synthetic oligonucleotide"
ucucugcuucaaguugcaa

SEQ ID NO: 932 - RNA, 19 nt, Artificial Sequence
  source: /note="Description of Artificial Sequence: Synthetic oligonucleotide"
uugcaacuugaagcagaga

SEQ ID NO: 933 - RNA, 19 nt, Artificial Sequence
  source: /note="Description of Artificial Sequence: Synthetic oligonucleotide"
cucugcuucaaguugcaac

SEQ ID NO: 934 - RNA, 19 nt, Artificial Sequence
  source: /note="Description of Artificial Sequence: Synthetic oligonucleotide"
guugcaacuugaagcagag

SEQ ID NO: 935 - RNA, 19 nt, Artificial Sequence
  source: /note="Description of Artificial Sequence: Synthetic oligonucleotide"
ucugcuucaaguugcaacu

SEQ ID NO: 936 - RNA, 19 nt, Artificial Sequence
  source: /note="Description of Artificial Sequence: Synthetic oligonucleotide"
aguugcaacuugaagcaga

SEQ ID NO: 937 - RNA, 19 nt, Artificial Sequence
  source: /note="Description of Artificial Sequence: Synthetic oligonucleotide"
uaucaucuuugggucauuc

SEQ ID NO: 938 - RNA, 19 nt, Artificial Sequence
  source: /note="Description of Artificial Sequence: Synthetic oligonucleotide"
gaaugacccaaagaugaua

SEQ ID NO: 939 - RNA, 19 nt, Artificial Sequence
  source: /note="Description of Artificial Sequence: Synthetic oligonucleotide"
aucaucuuugggucauucu

SEQ ID NO: 940 - RNA, 19 nt, Artificial Sequence
  source: /note="Description of Artificial Sequence: Synthetic oligonucleotide"
agaaugacccaaagaugau

SEQ ID NO: 941 - RNA, 19 nt, Artificial Sequence
  source: /note="Description of Artificial Sequence: Synthetic oligonucleotide"
ucaucuuugggucauucuu

SEQ ID NO: 942 - RNA, 19 nt, Artificial Sequence
  source: /note="Description of Artificial Sequence: Synthetic oligonucleotide"
aagaaugacccaaagauga

SEQ ID NO: 943 - RNA, 19 nt, Artificial Sequence
  source: /note="Description of Artificial Sequence: Synthetic oligonucleotide"
caucuuugggucauucuuc

SEQ ID NO: 944 - RNA, 19 nt, Artificial Sequence
  source: /note="Description of Artificial Sequence: Synthetic oligonucleotide"
gaagaaugacccaaagaug

SEQ ID NO: 945 - RNA, 19 nt, Artificial Sequence
  source: /note="Description of Artificial Sequence: Synthetic oligonucleotide"
cuuugggucauucuucacu

SEQ ID NO: 946 - RNA, 19 nt, Artificial Sequence
  source: /note="Description of Artificial Sequence: Synthetic oligonucleotide"
agugaagaaugacccaaag

SEQ ID NO: 947 - RNA, 19 nt, Artificial Sequence
  source: /note="Description of Artificial Sequence: Synthetic oligonucleotide"
uugggucauucuucacuuu

SEQ ID NO: 948 - RNA, 19 nt, Artificial Sequence
  source: /note="Description of Artificial Sequence: Synthetic oligonucleotide"
aaagugaagaaugacccaa

SEQ ID NO: 949 - RNA, 19 nt, Artificial Sequence
  source: /note="Description of Artificial Sequence: Synthetic oligonucleotide"
ugggucauucuucacuuug

SEQ ID NO: 950 - RNA, 19 nt, Artificial Sequence
  source: /note="Description of Artificial Sequence: Synthetic oligonucleotide"
caaagugaagaaugaccca

SEQ ID NO: 951 - RNA, 19 nt, Artificial Sequence
  source: /note="Description of Artificial Sequence: Synthetic oligonucleotide"
gggucauucuucacuuuga

SEQ ID NO: 952 - RNA, 19 nt, Artificial Sequence
  source: /note="Description of Artificial Sequence: Synthetic oligonucleotide"
ucaaagugaagaaugaccc

SEQ ID NO: 953 - RNA, 19 nt, Artificial Sequence
  source: /note="Description of Artificial Sequence: Synthetic oligonucleotide"
ggucauucuucacuuugaa

SEQ ID NO: 954 - RNA, 19 nt, Artificial Sequence
  source: /note="Description of Artificial Sequence: Synthetic oligonucleotide"
uucaaagugaagaaugacc

SEQ ID NO: 955 - RNA, 19 nt, Artificial Sequence
  source: /note="Description of Artificial Sequence: Synthetic oligonucleotide"
gucauucuucacuuugaac

SEQ ID NO: 956 - RNA, 19 nt, Artificial Sequence
  source: /note="Description of Artificial Sequence: Synthetic oligonucleotide"
guucaaagugaagaaugac

SEQ ID NO: 957 - RNA, 19 nt, Artificial Sequence
  source: /note="Description of Artificial Sequence: Synthetic oligonucleotide"
cauucuucacuuugaacuu

SEQ ID NO: 958 - RNA, 19 nt, Artificial Sequence
  source: /note="Description of Artificial Sequence: Synthetic oligonucleotide"
aaguucaaagugaagaaug

SEQ ID NO: 959 - RNA, 19 nt, Artificial Sequence
  source: /note="Description of Artificial Sequence: Synthetic oligonucleotide"
ucacuuugaacuuguucau

SEQ ID NO: 960 - RNA, 19 nt, Artificial Sequence
  source: /note="Description of Artificial Sequence: Synthetic oligonucleotide"
augaacaaguucaaaguga

SEQ ID NO: 961 - RNA, 19 nt, Artificial Sequence
  source: /note="Description of Artificial Sequence: Synthetic oligonucleotide"
cuuguucauuggugucauc

SEQ ID NO: 962 - RNA, 19 nt, Artificial Sequence
  source: /note="Description of Artificial Sequence: Synthetic oligonucleotide"
gaugacaccaaugaacaag

SEQ ID NO: 963 - RNA, 19 nt, Artificial Sequence
  source: /note="Description of Artificial Sequence: Synthetic oligonucleotide"
gugucaucauagauaauuu

SEQ ID NO: 964 - RNA, 19 nt, Artificial Sequence
  source: /note="Description of Artificial Sequence: Synthetic oligonucleotide"
aaauuaucuaugaugacac

SEQ ID NO: 965 - RNA, 19 nt, Artificial Sequence
  source: /note="Description of Artificial Sequence: Synthetic oligonucleotide"
ugucaucauagauaauuuc

SEQ ID NO: 966 - RNA, 19 nt, Artificial Sequence
  source: /note="Description of Artificial Sequence: Synthetic oligonucleotide"
gaaauuaucuaugaugaca

SEQ ID NO: 967 - RNA, 19 nt, Artificial Sequence
  source: /note="Description of Artificial Sequence: Synthetic oligonucleotide"
gaggucaagacaucuuuau

SEQ ID NO: 968 - RNA, 19 nt, Artificial Sequence
  source: /note="Description of Artificial Sequence: Synthetic oligonucleotide"
auaaagaugucuugaccuc

SEQ ID NO: 969 - RNA, 19 nt, Artificial Sequence
  source: /note="Description of Artificial Sequence: Synthetic oligonucleotide"
aggucaagacaucuuuaug

SEQ ID NO: 970 - RNA, 19 nt, Artificial Sequence
  source: /note="Description of Artificial Sequence: Synthetic oligonucleotide"
cauaaagaugucuugaccu

SEQ ID NO: 971 - RNA, 19 nt, Artificial Sequence
  source: /note="Description of Artificial Sequence: Synthetic oligonucleotide"
ggucaagacaucuuuauga

SEQ ID NO: 972 - RNA, 19 nt, Artificial Sequence
  source: /note="Description of Artificial Sequence: Synthetic oligonucleotide"
ucauaaagaugucuugacc

SEQ ID NO: 973 - RNA, 19 nt, Artificial Sequence
  source: /note="Description of Artificial Sequence: Synthetic oligonucleotide"
ccacaaaagccaauuccuc

SEQ ID NO: 974 - RNA, 19 nt, Artificial Sequence
  source: /note="Description of Artificial Sequence: Synthetic oligonucleotide"
gaggaauuggcuuuugugg

SEQ ID NO: 975 - RNA, 19 nt, Artificial Sequence
  source: /note="Description of Artificial Sequence: Synthetic oligonucleotide"
gaccuagugacaaaucaag

SEQ ID NO: 976 - RNA, 19 nt, Artificial Sequence
  source: /note="Description of Artificial Sequence: Synthetic oligonucleotide"
cuugauuugucacuagguc

SEQ ID NO: 977 - RNA, 19 nt, Artificial Sequence
  source: /note="Description of Artificial Sequence: Synthetic oligonucleotide"
guaucaugguucuuaucug

SEQ ID NO: 978 - RNA, 19 nt, Artificial Sequence
  source: /note="Description of Artificial Sequence: Synthetic oligonucleotide"
cagauaagaaccaugauac

SEQ ID NO: 979 - RNA, 19 nt, Artificial Sequence
  source: /note="Description of Artificial Sequence: Synthetic oligonucleotide"
uaucaugguucuuaucugu

SEQ ID NO: 980 - RNA, 19 nt, Artificial Sequence
  source: /note="Description of Artificial Sequence: Synthetic oligonucleotide"
acagauaagaaccaugaua

SEQ ID NO: 981 - RNA, 19 nt, Artificial Sequence
  source: /note="Description of Artificial Sequence: Synthetic oligonucleotide"
ucaugguucuuaucugucu

SEQ ID NO: 982 - RNA, 19 nt, Artificial Sequence
  source: /note="Description of Artificial Sequence: Synthetic oligonucleotide"
agacagauaagaaccauga

SEQ ID NO: 983 - RNA, 19 nt, Artificial Sequence
  source: /note="Description of Artificial Sequence: Synthetic oligonucleotide"
caugguucuuaucugucuc

SEQ ID NO: 984 - RNA, 19 nt, Artificial Sequence
  source: /note="Description of Artificial Sequence: Synthetic oligonucleotide"
gagacagauaagaaccaug

SEQ ID NO: 985 - RNA, 19 nt, Artificial Sequence
  source: /note="Description of Artificial Sequence: Synthetic oligonucleotide"
augguucuuaucugucuca

SEQ ID NO: 986 - RNA, 19 nt, Artificial Sequence
  source: /note="Description of Artificial Sequence: Synthetic oligonucleotide"
ugagacagauaagaaccau

SEQ ID NO: 987 - RNA, 19 nt, Artificial Sequence
  source: /note="Description of Artificial Sequence: Synthetic oligonucleotide"
ugguucuuaucugucucaa

SEQ ID NO: 988 - RNA, 19 nt, Artificial Sequence
  source: /note="Description of Artificial Sequence: Synthetic oligonucleotide"
uugagacagauaagaacca

SEQ ID NO: 989 - RNA, 19 nt, Artificial Sequence
  source: /note="Description of Artificial Sequence: Synthetic oligonucleotide"
gguucuuaucugucucaac

SEQ ID NO: 990 - RNA, 19 nt, Artificial Sequence
  source: /note="Description of Artificial Sequence: Synthetic oligonucleotide"
guugagacagauaagaacc

SEQ ID NO: 991 - RNA, 19 nt, Artificial Sequence
  source: /note="Description of Artificial Sequence: Synthetic oligonucleotide"
guucuuaucugucucaaca

SEQ ID NO: 992 - RNA, 19 nt, Artificial Sequence
  source: /note="Description of Artificial Sequence: Synthetic oligonucleotide"
uguugagacagauaagaac

SEQ ID NO: 993 - RNA, 19 nt, Artificial Sequence
  source: /note="Description of Artificial Sequence: Synthetic oligonucleotide"
ucuuaucugucucaacaug

SEQ ID NO: 994 - RNA, 19 nt, Artificial Sequence
  source: /note="Description of Artificial Sequence: Synthetic oligonucleotide"
cauguugagacagauaaga

SEQ ID NO: 995 - RNA, 19 nt, Artificial Sequence
  source: /note="Description of Artificial Sequence: Synthetic oligonucleotide"
aucugucucaacaugguaa

SEQ ID NO: 996 - RNA, 19 nt, Artificial Sequence
  source: /note="Description of Artificial Sequence: Synthetic oligonucleotide"
uuaccauguugagacagau

SEQ ID NO: 997 - RNA, 19 nt, Artificial Sequence
  source: /note="Description of Artificial Sequence: Synthetic oligonucleotide"
ucugucucaacaugguaac

SEQ ID NO: 998 - RNA, 19 nt, Artificial Sequence
  source: /note="Description of Artificial Sequence: Synthetic oligonucleotide"
guuaccauguugagacaga

SEQ ID NO: 999 - RNA, 19 nt, Artificial Sequence
  source: /note="Description of Artificial Sequence: Synthetic oligonucleotide"
cugucucaacaugguaacc

SEQ ID NO: 1000 - RNA, 19 nt, Artificial Sequence
  source: /note="Description of Artificial Sequence: Synthetic oligonucleotide"
gguuaccauguugagacag

SEQ ID NO: 1001 - RNA, 19 nt, Artificial Sequence
  source: /note="Description of Artificial Sequence: Synthetic oligonucleotide"
uccuggucauguucaucua

SEQ ID NO: 1002 - RNA, 19 nt, Artificial Sequence
  source: /note="Description of Artificial Sequence: Synthetic oligonucleotide"
uagaugaacaugaccagga

SEQ ID NO: 1003 - RNA, 19 nt, Artificial Sequence
  source: /note="Description of Artificial Sequence: Synthetic oligonucleotide"
aguucauccuggaaguuca

SEQ ID NO: 1004 - RNA, 19 nt, Artificial Sequence
  source: /note="Description of Artificial Sequence: Synthetic oligonucleotide"
ugaacuuccaggaugaacu

SEQ ID NO: 1005 - RNA, 19 nt, Artificial Sequence
  source: /note="Description of Artificial Sequence: Synthetic oligonucleotide"
ccaucuguuggaauauucu

SEQ ID NO: 1006 - RNA, 19 nt, Artificial Sequence
  source: /note="Description of Artificial Sequence: Synthetic oligonucleotide"
agaauauuccaacagaugg

SEQ ID NO: 1007 - RNA, 19 nt, Artificial Sequence
  source: /note="Description of Artificial Sequence: Synthetic oligonucleotide"
caucuguuggaauauucua

SEQ ID NO: 1008 - RNA, 19 nt, Artificial Sequence
  source: /note="Description of Artificial Sequence: Synthetic oligonucleotide"
uagaauauuccaacagaug

SEQ ID NO: 1009 - RNA, 19 nt, Artificial Sequence
  source: /note="Description of Artificial Sequence: Synthetic oligonucleotide"
ucuguuggaauauucuacu

SEQ ID NO: 1010 - RNA, 19 nt, Artificial Sequence
  source: /note="Description of Artificial Sequence: Synthetic oligonucleotide"
aguagaauauuccaacaga

SEQ ID NO: 1011 - RNA, 19 nt, Artificial Sequence
  source: /note="Description of Artificial Sequence: Synthetic oligonucleotide"
cauacuggagaauuuuagu

SEQ ID NO: 1012 - RNA, 19 nt, Artificial Sequence
  source: /note="Description of Artificial Sequence: Synthetic oligonucleotide"
acuaaaauucuccaguaug

SEQ ID NO: 1013 - RNA, 19 nt, Artificial Sequence
  source: /note="Description of Artificial Sequence: Synthetic oligonucleotide"
cuccucuucucauagcaaa

SEQ ID NO: 1014 - RNA, 19 nt, Artificial Sequence
  source: /note="Description of Artificial Sequence: Synthetic oligonucleotide"
uuugcuaugagaagaggag

SEQ ID NO: 1015 - RNA, 19 nt, Artificial Sequence
  source: /note="Description of Artificial Sequence: Synthetic oligonucleotide"
uccucuucucauagcaaaa

SEQ ID NO: 1016 - RNA, 19 nt, Artificial Sequence
  source: /note="Description of Artificial Sequence: Synthetic oligonucleotide"
uuuugcuaugagaagagga

SEQ ID NO: 1017 - RNA, 19 nt, Artificial Sequence
  source: /note="Description of Artificial Sequence: Synthetic oligonucleotide"
ccucuucucauagcaaaac

SEQ ID NO: 1018 - RNA, 19 nt, Artificial Sequence
  source: /note="Description of Artificial Sequence: Synthetic oligonucleotide"
guuuugcuaugagaagagg

SEQ ID NO: 1019 - RNA, 19 nt, Artificial Sequence
  source: /note="Description of Artificial Sequence: Synthetic oligonucleotide"
cucuucucauagcaaaacc

SEQ ID NO: 1020 - RNA, 19 nt, Artificial Sequence
  source: /note="Description of Artificial Sequence: Synthetic oligonucleotide"
gguuuugcuaugagaagag

SEQ ID NO: 1021 - RNA, 19 nt, Artificial Sequence
  source: /note="Description of Artificial Sequence: Synthetic oligonucleotide"
gauccauugucuugacauc

SEQ ID NO: 1022 - RNA, 19 nt, Artificial Sequence
  source: /note="Description of Artificial Sequence: Synthetic oligonucleotide"
gaugucaagacaauggauc

SEQ ID NO: 1023 - RNA, 19 nt, Artificial Sequence
  source: /note="Description of Artificial Sequence: Synthetic oligonucleotide"
auccauugucuugacaucu

SEQ ID NO: 1024 - RNA, 19 nt, Artificial Sequence
  source: /note="Description of Artificial Sequence: Synthetic oligonucleotide"
agaugucaagacaauggau

SEQ ID NO: 1025 - RNA, 19 nt, Artificial Sequence
  source: /note="Description of Artificial Sequence: Synthetic oligonucleotide"
uccauugucuugacaucuu

SEQ ID NO: 1026 - RNA, 19 nt, Artificial Sequence
  source: /note="Description of Artificial Sequence: Synthetic oligonucleotide"
aagaugucaagacaaugga

SEQ ID NO: 1027 - RNA, 19 nt, Artificial Sequence
  source: /note="Description of Artificial Sequence: Synthetic oligonucleotide"
cauugucuugacaucuuau

SEQ ID NO: 1028 - RNA, 19 nt, Artificial Sequence
  source: /note="Description of Artificial Sequence: Synthetic oligonucleotide"
auaagaugucaagacaaug

SEQ ID NO: 1029 - RNA, 19 nt, Artificial Sequence
  source: /note="Description of Artificial Sequence: Synthetic oligonucleotide"
uugucuugacaucuuauuu

SEQ ID NO: 1030 - RNA, 19 nt, Artificial Sequence
  source: /note="Description of Artificial Sequence: Synthetic oligonucleotide"
aaauaagaugucaagacaa

SEQ ID NO: 1031 - RNA, 19 nt, Artificial Sequence
  source: /note="Description of Artificial Sequence: Synthetic oligonucleotide"
ugucuugacaucuuauuug

SEQ ID NO: 1032 - RNA, 19 nt, Artificial Sequence
  source: /note="Description of Artificial Sequence: Synthetic oligonucleotide"
caaauaagaugucaagaca

SEQ ID NO: 1033 - RNA, 19 nt, Artificial Sequence
  source: /note="Description of Artificial Sequence: Synthetic oligonucleotide"
gucuugacaucuuauuugc

SEQ ID NO: 1034 - RNA, 19 nt, Artificial Sequence
  source: /note="Description of Artificial Sequence: Synthetic oligonucleotide"
gcaaauaagaugucaagac

SEQ ID NO: 1035 - RNA, 19 nt, Artificial Sequence
  source: /note="Description of Artificial Sequence: Synthetic oligonucleotide"
ggagauggauucucuucgu

SEQ ID NO: 1036 - RNA, 19 nt, Artificial Sequence
  source: /note="Description of Artificial Sequence: Synthetic oligonucleotide"
acgaagagaauccaucucc

SEQ ID NO: 1037 - RNA, 19 nt, Artificial Sequence
  source: /note="Description of Artificial Sequence: Synthetic oligonucleotide"
gagauggauucucuucguu

SEQ ID NO: 1038 - RNA, 19 nt, Artificial Sequence
  source: /note="Description of Artificial Sequence: Synthetic oligonucleotide"
aacgaagagaauccaucuc

SEQ ID NO: 1039 - RNA, 19 nt, Artificial Sequence
  source: /note="Description of Artificial Sequence: Synthetic oligonucleotide"
agauggauucucuucguuc

SEQ ID NO: 1040 - RNA, 19 nt, Artificial Sequence
  source: /note="Description of Artificial Sequence: Synthetic oligonucleotide"
gaacgaagagaauccaucu

SEQ ID NO: 1041 - RNA, 19 nt, Artificial Sequence
  source: /note="Description of Artificial Sequence: Synthetic oligonucleotide"
gauggauucucuucguuca

SEQ ID NO: 1042 - RNA, 19 nt, Artificial Sequence
  source: /note="Description of Artificial Sequence: Synthetic oligonucleotide"
ugaacgaagagaauccauc

SEQ ID NO: 1043 - RNA, 19 nt, Artificial Sequence
  source: /note="Description of Artificial Sequence: Synthetic oligonucleotide"
auggauucucuucguucac

SEQ ID NO: 1044 - RNA, 19 nt, Artificial Sequence
  source: /note="Description of Artificial Sequence: Synthetic oligonucleotide"
gugaacgaagagaauccau

SEQ ID NO: 1045 - RNA, 19 nt, Artificial Sequence
  source: /note="Description of Artificial Sequence: Synthetic oligonucleotide"
uggauucucuucguucaca

SEQ ID NO: 1046 - RNA, 19 nt, Artificial Sequence
  source: /note="Description of Artificial Sequence: Synthetic oligonucleotide"
ugugaacgaagagaaucca

SEQ ID NO: 1047 - RNA, 19 nt, Artificial Sequence
  source: /note="Description of Artificial Sequence: Synthetic oligonucleotide"
ggauucucuucguucacag

SEQ ID NO: 1048 - RNA, 19 nt, Artificial Sequence
  source: /note="Description of Artificial Sequence: Synthetic oligonucleotide"
cugugaacgaagagaaucc

SEQ ID NO: 1049 - RNA, 19 nt, Artificial Sequence
  source: /note="Description of Artificial Sequence: Synthetic oligonucleotide"
gauucucuucguucacaga

SEQ ID NO: 1050 - RNA, 19 nt, Artificial Sequence
  source: /note="Description of Artificial Sequence: Synthetic oligonucleotide"
ucugugaacgaagagaauc

SEQ ID NO: 1051 - RNA, 19 nt, Artificial Sequence
  source: /note="Description of Artificial Sequence: Synthetic oligonucleotide"
uucucuucguucacagaug

SEQ ID NO: 1052 - RNA, 19 nt, Artificial Sequence
  source: /note="Description of Artificial Sequence: Synthetic oligonucleotide"
caucugugaacgaagagaa

SEQ ID NO: 1053 - RNA, 19 nt, Artificial Sequence
  source: /note="Description of Artificial Sequence: Synthetic oligonucleotide"
ucucuucguucacagaugg

SEQ ID NO: 1054 - RNA, 19 nt, Artificial Sequence
  source: /note="Description of Artificial Sequence: Synthetic oligonucleotide"
ccaucugugaacgaagaga

SEQ ID NO: 1055 - RNA, 19 nt, Artificial Sequence
  source: /note="Description of Artificial Sequence: Synthetic oligonucleotide"
cucuucguucacagaugga

SEQ ID NO: 1056 - RNA, 19 nt, Artificial Sequence
  source: /note="Description of Artificial Sequence: Synthetic oligonucleotide"
uccaucugugaacgaagag

SEQ ID NO: 1057 - RNA, 19 nt, Artificial Sequence
  source: /note="Description of Artificial Sequence: Synthetic oligonucleotide"
ucuucguucacagauggaa

SEQ ID NO: 1058 - RNA, 19 nt, Artificial Sequence
  source: /note="Description of Artificial Sequence: Synthetic oligonucleotide"
uuccaucugugaacgaaga

SEQ ID NO: 1059 - RNA, 19 nt, Artificial Sequence
  source: /note="Description of Artificial Sequence: Synthetic oligonucleotide"
agguucaugucugcaaauc

SEQ ID NO: 1060 - RNA, 19 nt, Artificial Sequence
  source: /note="Description of Artificial Sequence: Synthetic oligonucleotide"
gauuugcagacaugaaccu

SEQ ID NO: 1061 - RNA, 19 nt, Artificial Sequence
  source: /note="Description of Artificial Sequence: Synthetic oligonucleotide"
ucugcaaauccuuccaaag

SEQ ID NO: 1062 - RNA, 19 nt, Artificial Sequence
  source: /note="Description of Artificial Sequence: Synthetic oligonucleotide"
cuuuggaaggauuugcaga

SEQ ID NO: 1063 - RNA, 19 nt, Artificial Sequence
  source: /note="Description of Artificial Sequence: Synthetic oligonucleotide"
cugcaaauccuuccaaagu

SEQ ID NO: 1064 - RNA, 19 nt, Artificial Sequence
  source: /note="Description of Artificial Sequence: Synthetic oligonucleotide"
acuuuggaaggauuugcag

SEQ ID NO: 1065 - RNA, 19 nt, Artificial Sequence
  source: /note="Description of Artificial Sequence: Synthetic oligonucleotide"
gugucugcuacugucauuc

SEQ ID NO: 1066 - RNA, 19 nt, Artificial Sequence
  source: /note="Description of Artificial Sequence: Synthetic oligonucleotide"
gaaugacaguagcagacac

SEQ ID NO: 1067 - RNA, 19 nt, Artificial Sequence
  source: /note="Description of Artificial Sequence: Synthetic oligonucleotide"
ugucugcuacugucauuca

SEQ ID NO: 1068 - RNA, 19 nt, Artificial Sequence
  source: /note="Description of Artificial Sequence: Synthetic oligonucleotide"
ugaaugacaguagcagaca

SEQ ID NO: 1069 - RNA, 19 nt, Artificial Sequence
  source: /note="Description of Artificial Sequence: Synthetic oligonucleotide"
gucugcuacugucauucag

SEQ ID NO: 1070 - RNA, 19 nt, Artificial Sequence
  source: /note="Description of Artificial Sequence: Synthetic oligonucleotide"
cugaaugacaguagcagac

SEQ ID NO: 1071 - RNA, 19 nt, Artificial Sequence
  source: /note="Description of Artificial Sequence: Synthetic oligonucleotide"
accgcuuaaggcaaaaugu

SEQ ID NO: 1072 - RNA, 19 nt, Artificial Sequence
  source: /note="Description of Artificial Sequence: Synthetic oligonucleotide"
acauuuugccuuaagcggu

SEQ ID NO: 1073 - RNA, 19 nt, Artificial Sequence
  source: /note="Description of Artificial Sequence: Synthetic oligonucleotide"
ccgcuuaaggcaaaauguc

SEQ ID NO: 1074 - RNA, 19 nt, Artificial Sequence
  source: /note="Description of Artificial Sequence: Synthetic oligonucleotide"
gacauuuugccuuaagcgg

SEQ ID NO: 1075 - RNA, 19 nt, Artificial Sequence
  source: /note="Description of Artificial Sequence: Synthetic oligonucleotide"
ucuccaccuucauaugaua

SEQ ID NO: 1076 - RNA, 19 nt, Artificial Sequence
  source: /note="Description of Artificial Sequence: Synthetic oligonucleotide"
uaucauaugaagguggaga

SEQ ID NO: 1077 - RNA, 19 nt, Artificial Sequence
  source: /note="Description of Artificial Sequence: Synthetic oligonucleotide"
ugccaaaauccuuuuuauc

SEQ ID NO: 1078 - RNA, 19 nt, Artificial Sequence
  source: /note="Description of Artificial Sequence: Synthetic oligonucleotide"
gauaaaaaggauuuuggca

SEQ ID NO: 1079 - RNA, 19 nt, Artificial Sequence
  source: /note="Description of Artificial Sequence: Synthetic oligonucleotide"
gccaaaauccuuuuuauca

SEQ ID NO: 1080 - RNA, 19 nt, Artificial Sequence
  source: /note="Description of Artificial Sequence: Synthetic oligonucleotide"
ugauaaaaaggauuuuggc

SEQ ID NO: 1081 - RNA, 19 nt, Artificial Sequence
  source: /note="Description of Artificial Sequence: Synthetic oligonucleotide"
ucguaagagaacucuguag

SEQ ID NO: 1082 - RNA, 19 nt, Artificial Sequence
  source: /note="Description of Artificial Sequence: Synthetic oligonucleotide"
cuacagaguucucuuacga

SEQ ID NO: 1083 - RNA, 19 nt, Artificial Sequence
  source: /note="Description of Artificial Sequence: Synthetic oligonucleotide"
ucugccuugucaucuuuuc

SEQ ID NO: 1084 - RNA, 19 nt, Artificial Sequence
  source: /note="Description of Artificial Sequence: Synthetic oligonucleotide"
gaaaagaugacaaggcaga

SEQ ID NO: 1085 - RNA, 19 nt, Artificial Sequence
  source: /note="Description of Artificial Sequence: Synthetic oligonucleotide"
ugccuugucaucuuuucac

SEQ ID NO: 1086 - RNA, 19 nt, Artificial Sequence
  source: /note="Description of Artificial Sequence: Synthetic oligonucleotide"
ugaaaagaugacaaggcag

SEQ ID NO: 1087 - RNA, 19 nt, Artificial Sequence
  source: /note="Description of Artificial Sequence: Synthetic oligonucleotide"
cugccuugucaucuuuuca

SEQ ID NO: 1088 - RNA, 19 nt, Artificial Sequence
  source: /note="Description of Artificial Sequence: Synthetic oligonucleotide"
gugaaaagaugacaaggca

SEQ ID NO: 1089 - RNA, 19 nt, Artificial Sequence
  source: /note="Description of Artificial Sequence: Synthetic oligonucleotide"
gccuugucaucuuuucaca

SEQ ID NO: 1090 - RNA, 19 nt, Artificial Sequence
  source: /note="Description of Artificial Sequence: Synthetic oligonucleotide"
ugugaaaagaugacaaggc

SEQ ID NO: 1091 - RNA, 19 nt, Artificial Sequence
  source: /note="Description of Artificial Sequence: Synthetic oligonucleotide"
ccuugucaucuuuucacag

SEQ ID NO: 1092 - RNA, 19 nt, Artificial Sequence
  source: /note="Description of Artificial Sequence: Synthetic oligonucleotide"
cugugaaaagaugacaagg

SEQ ID NO: 1093 - RNA, 19 nt, Artificial Sequence
  source: /note="Description of Artificial Sequence: Synthetic oligonucleotide"
caucuuuucacaggauugu

SEQ ID NO: 1094 - RNA, 19 nt, Artificial Sequence
  source: /note="Description of Artificial Sequence: Synthetic oligonucleotide"
acaauccugugaaaagaug

SEQ ID NO: 1095 - RNA, 19 nt, Artificial Sequence
  source: /note="Description of Artificial Sequence: Synthetic oligonucleotide"
cccauguaaauaaacaaca

SEQ ID NO: 1096 - RNA, 19 nt, Artificial Sequence
  source: /note="Description of Artificial Sequence: Synthetic oligonucleotide"
uguuguuuauuuacauggg

SEQ ID NO: 1097 - RNA, 19 nt, Artificial Sequence
  source: /note="Description of Artificial Sequence: Synthetic oligonucleotide"
cauucaucuugacucacau

SEQ ID NO: 1098 - RNA, 19 nt, Artificial Sequence
  source: /note="Description of Artificial Sequence: Synthetic oligonucleotide"
augugagucaagaugaaug

SEQ ID NO: 1099 - RNA, 19 nt, Artificial Sequence
  source: /note="Description of Artificial Sequence: Synthetic oligonucleotide"
acauauuacacuccucaaa

SEQ ID NO: 1100 - RNA, 19 nt, Artificial Sequence
  source: /note="Description of Artificial Sequence: Synthetic oligonucleotide"
uuugaggaguguaauaugu

SEQ ID NO: 1101 - RNA, 19 nt, Artificial Sequence
  source: /note="Description of Artificial Sequence: Synthetic oligonucleotide"
cauauuacacuccucaaaa

SEQ ID NO: 1102 - RNA, 19 nt, Artificial Sequence
  source: /note="Description of Artificial Sequence: Synthetic oligonucleotide"
uuuugaggaguguaauaug

SEQ ID NO: 1103 - RNA, 19 nt, Artificial Sequence
  source: /note="Description of Artificial Sequence: Synthetic oligonucleotide"
ugcccaaaauacugauaau

SEQ ID NO: 1104 - RNA, 19 nt, Artificial Sequence
  source: /note="Description of Artificial Sequence: Synthetic oligonucleotide"
auuaucaguauuuugggca

SEQ ID NO: 1105 - RNA, 19 nt, Artificial Sequence
  source: /note="Description of Artificial Sequence: Synthetic oligonucleotide"
gcccaaaauacugauaaua

SEQ ID NO: 1106 - RNA, 19 nt, Artificial Sequence
  source: /note="Description of Artificial Sequence: Synthetic oligonucleotide"
uauuaucaguauuuugggc

SEQ ID NO: 1107 - RNA, 19 nt, Artificial Sequence
  source: /note="Description of Artificial Sequence: Synthetic oligonucleotide"
cugauaauagucucuuaaa

SEQ ID NO: 1108 - RNA, 19 nt, Artificial Sequence
  source: /note="Description of Artificial Sequence: Synthetic oligonucleotide"
uuuaagagacuauuaucag

SEQ ID NO: 1109 - RNA, 19 nt, Artificial Sequence
  source: /note="Description of Artificial Sequence: Synthetic oligonucleotide"
gucaaauuuuccugcuuuc

SEQ ID NO: 1110 - RNA, 19 nt, Artificial Sequence
  source: /note="Description of Artificial Sequence: Synthetic oligonucleotide"
gaaagcaggaaaauuugac

SEQ ID NO: 1111 - RNA, 19 nt, Artificial Sequence
  source: /note="Description of Artificial Sequence: Synthetic oligonucleotide"
ucaaauuuuccugcuuucu

SEQ ID NO: 1112 - RNA, 19 nt, Artificial Sequence
  source: /note="Description of Artificial Sequence: Synthetic oligonucleotide"
agaaagcaggaaaauuuga

SEQ ID NO: 1113 - RNA, 19 nt, Artificial Sequence
  source: /note="Description of Artificial Sequence: Synthetic oligonucleotide"
caaauuuuccugcuuucuu

SEQ ID NO: 1114 - RNA, 19 nt, Artificial Sequence
  source: /note="Description of Artificial Sequence: Synthetic oligonucleotide"
aagaaagcaggaaaauuug

SEQ ID NO: 1115 - RNA, 19 nt, Artificial Sequence
  source: /note="Description of Artificial Sequence: Synthetic oligonucleotide"
auuguuuagucauccuuuc

SEQ ID NO: 1116 - RNA, 19 nt, Artificial Sequence
  source: /note="Description of Artificial Sequence: Synthetic oligonucleotide"
gaaaggaugacuaaacaau

SEQ ID NO: 1117 - RNA, 19 nt, Artificial Sequence
  source: /note="Description of Artificial Sequence: Synthetic oligonucleotide"
gcaucacuuguauacaauc

SEQ ID NO: 1118 - RNA, 19 nt, Artificial Sequence
  source: /note="Description of Artificial Sequence: Synthetic oligonucleotide"
gauuguauacaagugaugc

SEQ ID NO: 1119 - RNA, 19 nt, Artificial Sequence
  source: /note="Description of Artificial Sequence: Synthetic oligonucleotide"
caccaacuuacuuuccuaa

SEQ ID NO: 1120 - RNA, 19 nt, Artificial Sequence
  source: /note="Description of Artificial Sequence: Synthetic oligonucleotide"
uuaggaaaguaaguuggug

SEQ ID NO: 1121 - RNA, 19 nt, Artificial Sequence
  source: /note="Description of Artificial Sequence: Synthetic oligonucleotide"
accaacuuacuuuccuaaa

SEQ ID NO: 1122 - RNA, 19 nt, Artificial Sequence
  source: /note="Description of Artificial Sequence: Synthetic oligonucleotide"
uuuaggaaaguaaguuggu

SEQ ID NO: 1123 - RNA, 19 nt, Artificial Sequence
  source: /note="Description of Artificial Sequence: Synthetic oligonucleotide"
ccaacuuacuuuccuaaau

SEQ ID NO: 1124 - RNA, 19 nt, Artificial Sequence
  source: /note="Description of Artificial Sequence: Synthetic oligonucleotide"
auuuaggaaaguaaguugg

SEQ ID NO: 1125 - RNA, 19 nt, Artificial Sequence
  source: /note="Description of Artificial Sequence: Synthetic oligonucleotide"
caacuuacuuuccuaaauu

SEQ ID NO: 1126 - RNA, 19 nt, Artificial Sequence
  source: /note="Description of Artificial Sequence: Synthetic oligonucleotide"
aauuuaggaaaguaaguug

SEQ ID NO: 1127 - RNA, 19 nt, Artificial Sequence
  source: /note="Description of Artificial Sequence: Synthetic oligonucleotide"
aggaagaugucaccuucuc

SEQ ID NO: 1128 - RNA, 19 nt, Artificial Sequence
  source: /note="Description of Artificial Sequence: Synthetic oligonucleotide"
gaagaugucaccuucuccu

SEQ ID NO: 1129 - skipped

SEQ ID NO: 1130 - RNA, 19 nt, Artificial Sequence
  source: /note="Description of Artificial Sequence: Synthetic oligonucleotide"
aggagaaggugacaucuuc

SEQ ID NO: 1131 - RNA, 19 nt, Artificial Sequence
  source: /note="Description of Artificial Sequence: Synthetic oligonucleotide"
agaugucaccuucuccuua

SEQ ID NO: 1132 - RNA, 19 nt, Artificial Sequence
  source: /note="Description of Artificial Sequence: Synthetic oligonucleotide"
uaaggagaaggugacaucu

SEQ ID NO: 1133 - RNA, 19 nt, Artificial Sequence
  source: /note="Description of Artificial Sequence: Synthetic oligonucleotide"
gaugucaccuucuccuuaa

SEQ ID NO: 1134 - RNA, 19 nt, Artificial Sequence
  source: /note="Description of Artificial Sequence: Synthetic oligonucleotide"
uuaaggagaaggugacauc

SEQ ID NO: 1135 - RNA, 19 nt, Artificial Sequence
  source: /note="Description of Artificial Sequence: Synthetic oligonucleotide"
augucaccuucuccuuaaa

SEQ ID NO: 1136 - RNA, 19 nt, Artificial Sequence
  source: /note="Description of Artificial Sequence: Synthetic oligonucleotide"
uuuaaggagaaggugacau

SEQ ID NO: 1137 - RNA, 19 nt, Artificial Sequence
  source: /note="Description of Artificial Sequence: Synthetic oligonucleotide"
ugucaccuucuccuuaaaa

SEQ ID NO: 1138 - RNA, 19 nt, Artificial Sequence
  source: /note="Description of Artificial Sequence: Synthetic oligonucleotide"
uuuuaaggagaaggugaca

SEQ ID NO: 1139 - RNA, 19 nt, Artificial Sequence
  source: /note="Description of Artificial Sequence: Synthetic oligonucleotide"
gucaccuucuccuuaaaau

SEQ ID NO: 1140 - RNA, 19 nt, Artificial Sequence
  source: /note="Description of Artificial Sequence: Synthetic oligonucleotide"
auuuuaaggagaaggugac

SEQ ID NO: 1141 - RNA, 19 nt, Artificial Sequence
  source: /note="Description of Artificial Sequence: Synthetic oligonucleotide"
ucaccuucuccuuaaaauu

SEQ ID NO: 1142 - RNA, 19 nt, Artificial Sequence
  source: /note="Description of Artificial Sequence: Synthetic oligonucleotide"
aauuuuaaggagaagguga

SEQ ID NO: 1143 - RNA, 19 nt, Artificial Sequence
  source: /note="Description of Artificial Sequence: Synthetic oligonucleotide"
accuucuccuuaaaauucu

SEQ ID NO: 1144 - RNA, 19 nt, Artificial Sequence
  source: /note="Description of Artificial Sequence: Synthetic oligonucleotide"
agaauuuuaaggagaaggu

SEQ ID NO: 1145 - RNA, 19 nt, Artificial Sequence
  source: /note="Description of Artificial Sequence: Synthetic oligonucleotide"
ccuucuccuuaaaauucua

SEQ ID NO: 1146 - RNA, 19 nt, Artificial Sequence
  source: /note="Description of Artificial Sequence: Synthetic oligonucleotide"
uagaauuuuaaggagaagg

SEQ ID NO: 1147 - RNA, 19 nt, Artificial Sequence
  source: /note="Description of Artificial Sequence: Synthetic oligonucleotide"
cuucuccuuaaaauucuau

SEQ ID NO: 1148 - RNA, 19 nt, Artificial Sequence
  source: /note="Description of Artificial Sequence: Synthetic oligonucleotide"
auagaauuuuaaggagaag

SEQ ID NO: 1149 - RNA, 19 nt, Artificial Sequence
  source: /note="Description of Artificial Sequence: Synthetic oligonucleotide"
ugagaucuuucuucuauaa

SEQ ID NO: 1150 - RNA, 19 nt, Artificial Sequence
  source: /note="Description of Artificial Sequence: Synthetic oligonucleotide"
uuauagaagaaagaucuca

SEQ ID NO: 1151 - RNA, 19 nt, Artificial Sequence
  source: /note="Description of Artificial Sequence: Synthetic oligonucleotide"
gaucuuucuucuauaaagu

SEQ ID NO: 1152 - RNA, 19 nt, Artificial Sequence
  source: /note="Description of Artificial Sequence: Synthetic oligonucleotide"
acuuuauagaagaaagauc

SEQ ID NO: 1153 - RNA, 19 nt, Artificial Sequence
  source: /note="Description of Artificial Sequence: Synthetic oligonucleotide"
uaccaucuuagguucauuc

SEQ ID NO: 1154 - RNA, 19 nt, Artificial Sequence
  source: /note="Description of Artificial Sequence: Synthetic oligonucleotide"
gaaugaaccuaagauggua

SEQ ID NO: 1155 - RNA, 19 nt, Artificial Sequence
  source: /note="Description of Artificial Sequence: Synthetic oligonucleotide"
accaucuuagguucauuca

SEQ ID NO: 1156 - RNA, 19 nt, Artificial Sequence
  source: /note="Description of Artificial Sequence: Synthetic oligonucleotide"
ugaaugaaccuaagauggu

SEQ ID NO: 1157 - RNA, 19 nt, Artificial Sequence
  source: /note="Description of Artificial Sequence: Synthetic oligonucleotide"
ccaucuuagguucauucau

SEQ ID NO: 1158 - RNA, 19 nt, Artificial Sequence
  source: /note="Description of Artificial Sequence: Synthetic oligonucleotide"
augaaugaaccuaagaugg

SEQ ID NO: 1159 - RNA, 19 nt, Artificial Sequence
  source: /note="Description of Artificial Sequence: Synthetic oligonucleotide"
caucuuagguucauucauc

SEQ ID NO: 1160 - RNA, 19 nt, Artificial Sequence
  source: /note="Description of Artificial Sequence: Synthetic oligonucleotide"
gaugaaugaaccuaagaug

SEQ ID NO: 1161 - RNA, 19 nt, Artificial Sequence
  source: /note="Description of Artificial Sequence: Synthetic oligonucleotide"
ucuuagguucauucaucuu

SEQ ID NO: 1162 - RNA, 19 nt, Artificial Sequence
  source: /note="Description of Artificial Sequence: Synthetic oligonucleotide"
aagaugaaugaaccuaaga

SEQ ID NO: 1163 - RNA, 19 nt, Artificial Sequence
  source: /note="Description of Artificial Sequence: Synthetic oligonucleotide"
cuuagguucauucaucuua

SEQ ID NO: 1164 - RNA, 19 nt, Artificial Sequence
  source: /note="Description of Artificial Sequence: Synthetic oligonucleotide"
uaagaugaaugaaccuaag

SEQ ID NO: 1165 - RNA, 19 nt, Artificial Sequence
  source: /note="Description of Artificial Sequence: Synthetic oligonucleotide"
uuagguucauucaucuuag

SEQ ID NO: 1166 - RNA, 19 nt, Artificial Sequence
  source: /note="Description of Artificial Sequence: Synthetic oligonucleotide"
cuaagaugaaugaaccuaa

SEQ ID NO: 1167 - RNA, 19 nt, Artificial Sequence
  source: /note="Description of Artificial Sequence: Synthetic oligonucleotide"
uagguucauucaucuuagg

SEQ ID NO: 1168 - RNA, 19 nt, Artificial Sequence
  source: /note="Description of Artificial Sequence: Synthetic oligonucleotide"
ccuaagaugaaugaaccua

SEQ ID NO: 1169 - RNA, 19 nt, Artificial Sequence
  source: /note="Description of Artificial Sequence: Synthetic oligonucleotide"
cugcauuaugaauacuuac

SEQ ID NO: 1170 - RNA, 19 nt, Artificial Sequence
  source: /note="Description of Artificial Sequence: Synthetic oligonucleotide"
guaaguauucauaaugcag

SEQ ID NO: 1171 - RNA, 19 nt, Artificial Sequence
  source: /note="Description of Artificial Sequence: Synthetic oligonucleotide"
acacaauuucuucuuagca

SEQ ID NO: 1172 - RNA, 19 nt, Artificial Sequence
  source: /note="Description of Artificial Sequence: Synthetic oligonucleotide"
ugcuaagaagaaauugugu

SEQ ID NO: 1173 - RNA, 19 nt, Artificial Sequence
  source: /note="Description of Artificial Sequence: Synthetic oligonucleotide"
guucuuuuuccuauuucau

SEQ ID NO: 1174 - RNA, 19 nt, Artificial Sequence
  source: /note="Description of Artificial Sequence: Synthetic oligonucleotide"
augaaauaggaaaaagaac

SEQ ID NO: 1175 - RNA, 19 nt, Artificial Sequence
  source: /note="Description of Artificial Sequence: Synthetic oligonucleotide"
uccuauuucaugaacuaug

SEQ ID NO: 1176 - RNA, 19 nt, Artificial Sequence
  source: /note="Description of Artificial Sequence: Synthetic oligonucleotide"
cauaguucaugaaauagga

SEQ ID NO: 1177 - RNA, 19 nt, Artificial Sequence
  source: /note="Description of Artificial Sequence: Synthetic oligonucleotide"
ccuauuucaugaacuaugu

SEQ ID NO: 1178 - RNA, 19 nt, Artificial Sequence
  source: /note="Description of Artificial Sequence: Synthetic oligonucleotide"
acauaguucaugaaauagg

SEQ ID NO: 1179 - RNA, 19 nt, Artificial Sequence
  source: /note="Description of Artificial Sequence: Synthetic oligonucleotide"
augucuacuugugacuuuu

SEQ ID NO: 1180 - RNA, 19 nt, Artificial Sequence
  source: /note="Description of Artificial Sequence: Synthetic oligonucleotide"
aaaagucacaaguagacau

SEQ ID NO: 1181 - RNA, 19 nt, Artificial Sequence
  source: /note="Description of Artificial Sequence: Synthetic oligonucleotide"
ugucuacuugugacuuuuu

SEQ ID NO: 1182 - RNA, 19 nt, Artificial Sequence
  source: /note="Description of Artificial Sequence: Synthetic oligonucleotide"
aaaaagucacaaguagaca

SEQ ID NO: 1183 - RNA, 19 nt, Artificial Sequence
  source: /note="Description of Artificial Sequence: Synthetic oligonucleotide"
ucuacuugugacuuuuuau

SEQ ID NO: 1184 - RNA, 19 nt, Artificial Sequence
  source: /note="Description of Artificial Sequence: Synthetic oligonucleotide"
auaaaaagucacaaguaga

SEQ ID NO: 1185 - RNA, 19 nt, Artificial Sequence
  source: /note="Description of Artificial Sequence: Synthetic oligonucleotide"
cuacuugugacuuuuuauc

SEQ ID NO: 1186 - RNA, 19 nt, Artificial Sequence
  source: /note="Description of Artificial Sequence: Synthetic oligonucleotide"
guucuaaauagcuauuuca

SEQ ID NO: 1187 - skipped

SEQ ID NO: 1188 - RNA, 19 nt, Artificial Sequence
  source: /note="Description of Artificial Sequence: Synthetic oligonucleotide"
ugaaauagcuauuuagaac

SEQ ID NO: 1189 - RNA, 19 nt, Artificial Sequence
  source: /note="Description of Artificial Sequence: Synthetic oligonucleotide"
gcuguuuacauaggauucu

SEQ ID NO: 1190 - RNA, 19 nt, Artificial Sequence
  source: /note="Description of Artificial Sequence: Synthetic oligonucleotide"
agaauccuauguaaacagc

SEQ ID NO: 1191 - RNA, 19 nt, Artificial Sequence
  source: /note="Description of Artificial Sequence: Synthetic oligonucleotide"
gcucaaaauguuugaguuu

SEQ ID NO: 1192 - RNA, 19 nt, Artificial Sequence
  source: /note="Description of Artificial Sequence: Synthetic oligonucleotide"
aaacucaaacauuuugagc

SEQ ID NO: 1193-1794 - skipped (602 entries)

SEQ ID NO: 1795 - RNA, 21 nt, Artificial Sequence
  source: /note="Description of Artificial Sequence: Synthetic oligonucleotide"
uuuguagaucuugcaauuaca

SEQ ID NO: 1796 - RNA, 23 nt, Artificial Sequence
  source: /note="Description of Artificial Sequence: Synthetic oligonucleotide"
uguaauugcaagaucuacaaaag

SEQ ID NO: 1797 - RNA, 21 nt, Artificial Sequence
  source: /note="Description of Artificial Sequence: Synthetic oligonucleotide"
uucuguguaggagaauucaca

SEQ ID NO: 1798 - RNA, 23 nt, Artificial Sequence
  source: /note="Description of Artificial Sequence: Synthetic oligonucleotide"
ugugaauucuccuacacagaagc

SEQ ID NO: 1799 - RNA, 21 nt, Artificial Sequence
  source: /note="Description of Artificial Sequence: Synthetic oligonucleotide"
augugaaacaaaccuuacgua

SEQ ID NO: 1800 - RNA, 23 nt, Artificial Sequence
  source: /note="Description of Artificial Sequence: Synthetic oligonucleotide"
uacguaagguuuguuucacauaa

SEQ ID NO: 1801 - RNA, 21 nt, Artificial Sequence
  source: /note="Description of Artificial Sequence: Synthetic oligonucleotide"
uguaggagaauucacuuuuca

SEQ ID NO: 1802 - RNA, 23 nt, Artificial Sequence
  source: /note="Description of Artificial Sequence: Synthetic oligonucleotide"
ugaaaagugaauucuccuacaca

SEQ ID NO: 1803 - RNA, 21 nt, Artificial Sequence
  source: /note="Description of Artificial Sequence: Synthetic oligonucleotide"
uaugugaaacaaaccuuacga

SEQ ID NO: 1804 - RNA, 23 nt, Artificial Sequence
  source: /note="Description of Artificial Sequence: Synthetic oligonucleotide"
ucguaagguuuguuucacauaau

SEQ ID NO: 1805 - RNA, 21 nt, Artificial Sequence
  source: /note="Description of Artificial Sequence: Synthetic oligonucleotide"
agcauaaauguuuucgaaaua

SEQ ID NO: 1806 - RNA, 23 nt, Artificial Sequence
  source: /note="Description of Artificial Sequence: Synthetic oligonucleotide"
uauuucgaaaacauuuaugcuuc

SEQ ID NO: 1807 - RNA, 21 nt, Artificial Sequence
  source: /note="Description of Artificial Sequence: Synthetic oligonucleotide"
gaucuucuuugucguagugaa

SEQ ID NO: 1808 - RNA, 23 nt, Artificial Sequence
  source: /note="Description of Artificial Sequence: Synthetic oligonucleotide"
uucacuacgacaaagaagaucau

SEQ ID NO: 1809 - RNA, 21 nt, Artificial Sequence
  source: /note="Description of Artificial Sequence: Synthetic oligonucleotide"
ggcguuguaguuccuaucuca

SEQ ID NO: 1810 - RNA, 23 nt, Artificial Sequence
  source: /note="Description of Artificial Sequence: Synthetic oligonucleotide"
ugagauaggaacuacaacgccuu

SEQ ID NO: 1811 - RNA, 21 nt, Artificial Sequence
  source: /note="Description of Artificial Sequence: Synthetic oligonucleotide"
aucuucuuugucguagugaua

SEQ ID NO: 1812 - RNA, 23 nt, Artificial Sequence
  source: /note="Description of Artificial Sequence: Synthetic oligonucleotide"
uaucacuacgacaaagaagauca

SEQ ID NO: 1813 - RNA, 21 nt, Artificial Sequence
  source: /note="Description of Artificial Sequence: Synthetic oligonucleotide"
ugguuucagcacagauucaga

SEQ ID NO: 1814 - RNA, 23 nt, Artificial Sequence
  source: /note="Description of Artificial Sequence: Synthetic oligonucleotide"
ucugaaucugugcugaaaccaca

SEQ ID NO: 1815 - RNA, 21 nt, Artificial Sequence
  source: /note="Description of Artificial Sequence: Synthetic oligonucleotide"
ugucgaguacacuuuuacuga

SEQ ID NO: 1816 - RNA, 23 nt, Artificial Sequence
  source: /note="Description of Artificial Sequence: Synthetic oligonucleotide"
ucaguaaaaguguacucgacauu

SEQ ID NO: 1817 - RNA, 21 nt, Artificial Sequence
  source: /note="Description of Artificial Sequence: Synthetic oligonucleotide"
aagcagaagaucugaauacua

SEQ ID NO: 1818 - RNA, 23 nt, Artificial Sequence
  source: /note="Description of Artificial Sequence: Synthetic oligonucleotide"
uaguauucagaucuucugcuugu

SEQ ID NO: 1819 - RNA, 21 nt, Artificial Sequence
  source: /note="Description of Artificial Sequence: Synthetic oligonucleotide"
caaguguuccuacugucauga

SEQ ID NO: 1820 - RNA, 23 nt, Artificial Sequence
  source: /note="Description of Artificial Sequence: Synthetic oligonucleotide"
ucaugacaguaggaacacuugaa

SEQ ID NO: 1821 - RNA, 21 nt, Artificial Sequence
  source: /note="Description of Artificial Sequence: Synthetic oligonucleotide"
augcugagaaauugucgaaaa

SEQ ID NO: 1822 - RNA, 23 nt, Artificial Sequence
  source: /note="Description of Artificial Sequence: Synthetic oligonucleotide"
uuuucgacaauuucucagcaucu

SEQ ID NO: 1823 - RNA, 21 nt, Artificial Sequence
  source: /note="Description of Artificial Sequence: Synthetic oligonucleotide"
auguuucuagcugauuugaua

SEQ ID NO: 1824 - RNA, 23 nt, Artificial Sequence
  source: /note="Description of Artificial Sequence: Synthetic oligonucleotide"
uaucaaaucagcuagaaacauac

SEQ ID NO: 1825 - RNA, 21 nt, Artificial Sequence
  source: /note="Description of Artificial Sequence: Synthetic oligonucleotide"
gagauggauucucuucguuca

SEQ ID NO: 1826 - RNA, 23 nt, Artificial Sequence
  source: /note="Description of Artificial Sequence: Synthetic oligonucleotide"
ugaacgaagagaauccaucuccc

SEQ ID NO: 1827 - RNA, 21 nt, Artificial Sequence
  source: /note="Description of Artificial Sequence: Synthetic oligonucleotide"
uugugacuuuaaguuuaguga

SEQ ID NO: 1828 - RNA, 23 nt, Artificial Sequence
  source: /note="Description of Artificial Sequence: Synthetic oligonucleotide"
ucacuaaacuuaaagucacaaua

SEQ ID NO: 1829 - RNA, 21 nt, Artificial Sequence
  source: /note="Description of Artificial Sequence: Synthetic oligonucleotide"
augaucuucuuugucguagua

SEQ ID NO: 1830 - RNA, 23 nt, Artificial Sequence
  source: /note="Description of Artificial Sequence: Synthetic oligonucleotide"
uacuacgacaaagaagaucaugu

SEQ ID NO: 1831 - RNA, 21 nt, Artificial Sequence
  source: /note="Description of Artificial Sequence: Synthetic oligonucleotide"
aagggaaaacaaucuuccgua

SEQ ID NO: 1832 - RNA, 23 nt, Artificial Sequence
  source: /note="Description of Artificial Sequence: Synthetic oligonucleotide"
uacggaagauuguuuucccuuug

SEQ ID NO: 1833 - RNA, 21 nt, Artificial Sequence
  source: /note="Description of Artificial Sequence: Synthetic oligonucleotide"
cuucugaaacauccaaacuga

SEQ ID NO: 1834 - RNA, 23 nt, Artificial Sequence
  source: /note="Description of Artificial Sequence: Synthetic oligonucleotide"
ucaguuuggauguuucagaagaa

SEQ ID NO: 1835 - RNA, 21 nt, Artificial Sequence
  source: /note="Description of Artificial Sequence: Synthetic oligonucleotide"
uugcuauaggaaauuugguca

SEQ ID NO: 1836 - RNA, 23 nt, Artificial Sequence
  source: /note="Description of Artificial Sequence: Synthetic oligonucleotide"
ugaccaaauuuccuauagcaagu

SEQ ID NO: 1837 - RNA, 21 nt, Artificial Sequence
  source: /note="Description of Artificial Sequence: Synthetic oligonucleotide"
uauugugacuuuaaguuuaga

SEQ ID NO: 1838 - RNA, 23 nt, Artificial Sequence
  source: /note="Description of Artificial Sequence: Synthetic oligonucleotide"
ucuaaacuuaaagucacaauaag

SEQ ID NO: 1839 - RNA, 21 nt, Artificial Sequence
  source: /note="Description of Artificial Sequence: Synthetic oligonucleotide"
uuggcagaaacccugauuaua

SEQ ID NO: 1840 - RNA, 23 nt, Artificial Sequence
  source: /note="Description of Artificial Sequence: Synthetic oligonucleotide"
uauaaucaggguuucugccaauu

SEQ ID NO: 1841 - RNA, 21 nt, Artificial Sequence
  source: /note="Description of Artificial Sequence: Synthetic oligonucleotide"
acaugaucuucuuugucguaa

SEQ ID NO: 1842 - RNA, 23 nt, Artificial Sequence
  source: /note="Description of Artificial Sequence: Synthetic oligonucleotide"
uuacgacaaagaagaucauguag

SEQ ID NO: 1843 - RNA, 21 nt, Artificial Sequence
  source: /note="Description of Artificial Sequence: Synthetic oligonucleotide"
agcuugaaguaaaauuagaca

SEQ ID NO: 1844 - RNA, 23 nt, Artificial Sequence
  source: /note="Description of Artificial Sequence: Synthetic oligonucleotide"
ugucuaauuuuacuucaagcuua

SEQ ID NO: 1845 - RNA, 21 nt, Artificial Sequence
  source: /note="Description of Artificial Sequence: Synthetic oligonucleotide"
uccaaaucguuccgaauguua

SEQ ID NO: 1846 - RNA, 23 nt, Artificial Sequence
  source: /note="Description of Artificial Sequence: Synthetic oligonucleotide"
uaacauucggaacgauuuggaac

SEQ ID NO: 1847 - RNA, 21 nt, Artificial Sequence
  source: /note="Description of Artificial Sequence: Synthetic oligonucleotide"
aucugagacugaauuugccga

SEQ ID NO: 1848 - RNA, 23 nt, Artificial Sequence
  source: /note="Description of Artificial Sequence: Synthetic oligonucleotide"
ucggcaaauucagucucagaucc

SEQ ID NO: 1849 - RNA, 21 nt, Artificial Sequence
  source: /note="Description of Artificial Sequence: Synthetic oligonucleotide"
gcguuguaguuccuaucucca

SEQ ID NO: 1850 - RNA, 23 nt, Artificial Sequence
  source: /note="Description of Artificial Sequence: Synthetic oligonucleotide"
uggagauaggaacuacaacgccu

SEQ ID NO: 1851 - RNA, 21 nt, Artificial Sequence
  source: /note="Description of Artificial Sequence: Synthetic oligonucleotide"
uauauuuuacaacauccguua

SEQ ID NO: 1852 - RNA, 23 nt, Artificial Sequence
  source: /note="Description of Artificial Sequence: Synthetic oligonucleotide"
uaacggauguuguaaaauauauc

SEQ ID NO: 1853 - RNA, 21 nt, Artificial Sequence
  source: /note="Description of Artificial Sequence: Synthetic oligonucleotide"
augucgaguacacuuuuacua

SEQ ID NO: 1854 - RNA, 23 nt, Artificial Sequence
  source: /note="Description of Artificial Sequence: Synthetic oligonucleotide"
uaguaaaaguguacucgacauuu

SEQ ID NO: 1855 - RNA, 21 nt, Artificial Sequence
  source: /note="Description of Artificial Sequence: Synthetic oligonucleotide"
ugauaguuaccuaguuugcaa

SEQ ID NO: 1856 - RNA, 23 nt, Artificial Sequence
  source: /note="Description of Artificial Sequence: Synthetic oligonucleotide"
uugcaaacuagguaacuaucaaa

SEQ ID NO: 1857 - RNA, 21 nt, Artificial Sequence
  source: /note="Description of Artificial Sequence: Synthetic oligonucleotide"
gacuuaccuuuagaguauuga

SEQ ID NO: 1858 - RNA, 23 nt, Artificial Sequence
  source: /note="Description of Artificial Sequence: Synthetic oligonucleotide"
ucaauacucuaaagguaagucuu

SEQ ID NO: 1859 - RNA, 21 nt, Artificial Sequence
  source: /note="Description of Artificial Sequence: Synthetic oligonucleotide"
cuaaauuauggaaguaaucua

SEQ ID NO: 1860 - RNA, 23 nt, Artificial Sequence
  source: /note="Description of Artificial Sequence: Synthetic oligonucleotide"
uagauuacuuccauaauuuagga

SEQ ID NO: 1861 - RNA, 21 nt, Artificial Sequence
  source: /note="Description of Artificial Sequence: Synthetic oligonucleotide"
agucaaguuccaaaucguuca

SEQ ID NO: 1862 - RNA, 23 nt, Artificial Sequence
  source: /note="Description of Artificial Sequence: Synthetic oligonucleotide"
ugaacgauuuggaacuugacuug

SEQ ID NO: 1863 - RNA, 21 nt, Artificial Sequence
  source: /note="Description of Artificial Sequence: Synthetic oligonucleotide"
ugaucuucuuugucguaguga

SEQ ID NO: 1864 - RNA, 23 nt, Artificial Sequence
  source: /note="Description of Artificial Sequence: Synthetic oligonucleotide"
ucacuacgacaaagaagaucaug

SEQ ID NO: 1865 - RNA, 21 nt, Artificial Sequence
  source: /note="Description of Artificial Sequence: Synthetic oligonucleotide"
guuugaacacaaaucuuucga

SEQ ID NO: 1866 - RNA, 23 nt, Artificial Sequence
  source: /note="Description of Artificial Sequence: Synthetic oligonucleotide"
ucgaaagauuuguguucaaaccu

SEQ ID NO: 1867 - RNA, 21 nt, Artificial Sequence
  source: /note="Description of Artificial Sequence: Synthetic oligonucleotide"
aaguuccaaaucguuccgaaa

SEQ ID NO: 1868 - RNA, 23 nt, Artificial Sequence
  source: /note="Description of Artificial Sequence: Synthetic oligonucleotide"
uuucggaacgauuuggaacuuga

SEQ ID NO: 1869 - RNA, 21 nt, Artificial Sequence
  source: /note="Description of Artificial Sequence: Synthetic oligonucleotide"
uguagaucuugcaauuaccaa

SEQ ID NO: 1870 - RNA, 23 nt, Artificial Sequence
  source: /note="Description of Artificial Sequence: Synthetic oligonucleotide"
uugguaauugcaagaucuacaaa

SEQ ID NO: 1871 - RNA, 21 nt, Artificial Sequence
  source: /note="Description of Artificial Sequence: Synthetic oligonucleotide"
caugaucuucuuugucguaga

SEQ ID NO: 1872 - RNA, 23 nt, Artificial Sequence
  source: /note="Description of Artificial Sequence: Synthetic oligonucleotide"
ucuacgacaaagaagaucaugua

SEQ ID NO: 1873 - RNA, 21 nt, Artificial Sequence
  source: /note="Description of Artificial Sequence: Synthetic oligonucleotide"
uugauaguuaccuaguuugca

SEQ ID NO: 1874 - RNA, 23 nt, Artificial Sequence
  source: /note="Description of Artificial Sequence: Synthetic oligonucleotide"
ugcaaacuagguaacuaucaaaa

SEQ ID NO: 1875 - RNA, 21 nt, Artificial Sequence
  source: /note="Description of Artificial Sequence: Synthetic oligonucleotide"
caccuucuccuuaaaauucua

SEQ ID NO: 1876 - RNA, 23 nt, Artificial Sequence
  source: /note="Description of Artificial Sequence: Synthetic oligonucleotide"
uagaauuuuaaggagaaggugac

SEQ ID NO: 1877 - RNA, 21 nt, Artificial Sequence
  source: /note="Description of Artificial Sequence: Synthetic oligonucleotide"
cugauuuccuaagaaagguga

SEQ ID NO: 1878 - RNA, 23 nt, Artificial Sequence
  source: /note="Description of Artificial Sequence: Synthetic oligonucleotide"
ucaccuuucuuaggaaaucagag

SEQ ID NO: 1879 - RNA, 21 nt, Artificial Sequence
  source: /note="Description of Artificial Sequence: Synthetic oligonucleotide"
ugagacugacacauuguaaua

SEQ ID NO: 1880 - RNA, 23 nt, Artificial Sequence
  source: /note="Description of Artificial Sequence: Synthetic oligonucleotide"
uauuacaaugugucagucucaag

SEQ ID NO: 1881 - RNA, 21 nt, Artificial Sequence
  source: /note="Description of Artificial Sequence: Synthetic oligonucleotide"
cugaauauacaaguauuagga

SEQ ID NO: 1882 - RNA, 23 nt, Artificial Sequence
  source: /note="Description of Artificial Sequence: Synthetic oligonucleotide"
uccuaauacuuguauauucagcc

SEQ ID NO: 1883 - RNA, 21 nt, Artificial Sequence
  source: /note="Description of Artificial Sequence: Synthetic oligonucleotide"
caacccaaaauacuuagcaua

SEQ ID NO: 1884 - RNA, 23 nt, Artificial Sequence
  source: /note="Description of Artificial Sequence: Synthetic oligonucleotide"
uaugcuaaguauuuuggguugug

SEQ ID NO: 1885 - RNA, 21 nt, Artificial Sequence
  source: /note="Description of Artificial Sequence: Synthetic oligonucleotide"
cugauaauagucucuuaaaca

SEQ ID NO: 1886 - RNA, 23 nt, Artificial Sequence
  source: /note="Description of Artificial Sequence: Synthetic oligonucleotide"
uguuuaagagacuauuaucagua

SEQ ID NO: 1887 - RNA, 21 nt, Artificial Sequence
  source: /note="Description of Artificial Sequence: Synthetic oligonucleotide"
uuugucguagugauuuuccua

SEQ ID NO: 1888 - RNA, 23 nt, Artificial Sequence
  source: /note="Description of Artificial Sequence: Synthetic oligonucleotide"
uaggaaaaucacuacgacaaaga

SEQ ID NO: 1889 - RNA, 21 nt, Artificial Sequence
  source: /note="Description of Artificial Sequence: Synthetic oligonucleotide"
ugaauauacaaguauuaggaa

SEQ ID NO: 1890 - RNA, 23 nt, Artificial Sequence
  source: /note="Description of Artificial Sequence: Synthetic oligonucleotide"
uuccuaauacuuguauauucagc

SEQ ID NO: 1891 - RNA, 21 nt, Artificial Sequence
  source: /note="Description of Artificial Sequence: Synthetic oligonucleotide"
agauggauucucuucguucaa

SEQ ID NO: 1892 - RNA, 23 nt, Artificial Sequence
  source: /note="Description of Artificial Sequence: Synthetic oligonucleotide"
uugaacgaagagaauccaucucc

SEQ ID NO: 1893 - RNA, 21 nt, Artificial Sequence
  source: /note="Description of Artificial Sequence: Synthetic oligonucleotide"
aauaucauaaagcuguuuaca

SEQ ID NO: 1894 - RNA, 23 nt, Artificial Sequence
  source: /note="Description of Artificial Sequence: Synthetic oligonucleotide"
uguaaacagcuuuaugauauuca

SEQ ID NO: 1895 - RNA, 21 nt, Artificial Sequence
  source: /note="Description of Artificial Sequence: Synthetic oligonucleotide"
ucuuuauaccaucuuagguua

SEQ ID NO: 1896 - RNA, 23 nt, Artificial Sequence
  source: /note="Description of Artificial Sequence: Synthetic oligonucleotide"
uaaccuaagaugguauaaagaau

SEQ ID NO: 1897 - RNA, 21 nt, Artificial Sequence
  source: /note="Description of Artificial Sequence: Synthetic oligonucleotide"
gcaaaggucacaauuuccuca

SEQ ID NO: 1898 - RNA, 23 nt, Artificial Sequence
  source: /note="Description of Artificial Sequence: Synthetic oligonucleotide"
ugaggaaauugugaccuuugcuc

SEQ ID NO: 1899 - RNA, 21 nt, Artificial Sequence
  source: /note="Description of Artificial Sequence: Synthetic oligonucleotide"
agucaccacucagcauucgua

SEQ ID NO: 1900 - RNA, 23 nt, Artificial Sequence
  source: /note="Description of Artificial Sequence: Synthetic oligonucleotide"
uacgaaugcugaguggugacuga

SEQ ID NO: 1901 - RNA, 21 nt, Artificial Sequence
  source: /note="Description of Artificial Sequence: Synthetic oligonucleotide"
ugcuauaggaaauuuggucua

SEQ ID NO: 1902 - RNA, 23 nt, Artificial Sequence
  source: /note="Description of Artificial Sequence: Synthetic oligonucleotide"
uagaccaaauuuccuauagcaag

SEQ ID NO: 1903 - RNA, 21 nt, Artificial Sequence
  source: /note="Description of Artificial Sequence: Synthetic oligonucleotide"
gacagagaugaugauuuacua

SEQ ID NO: 1904 - RNA, 23 nt, Artificial Sequence
  source: /note="Description of Artificial Sequence: Synthetic oligonucleotide"
uaguaaaucaucaucucugucuc

SEQ ID NO: 1905 - RNA, 21 nt, Artificial Sequence
  source: /note="Description of Artificial Sequence: Synthetic oligonucleotide"
aagucaaguuccaaaucguua

SEQ ID NO: 1906 - RNA, 23 nt, Artificial Sequence
  source: /note="Description of Artificial Sequence: Synthetic oligonucleotide"
uaacgauuuggaacuugacuugc

SEQ ID NO: 1907 - RNA, 21 nt, Artificial Sequence
  source: /note="Description of Artificial Sequence: Synthetic oligonucleotide"
uaggcuaaugacccaagauua

SEQ ID NO: 1908 - RNA, 23 nt, Artificial Sequence
  source: /note="Description of Artificial Sequence: Synthetic oligonucleotide"
uaaucuugggucauuagccuaaa

SEQ ID NO: 1909 - RNA, 21 nt, Artificial Sequence
  source: /note="Description of Artificial Sequence: Synthetic oligonucleotide"
aagagcuuauuaaguauaaga

SEQ ID NO: 1910 - RNA, 23 nt, Artificial Sequence
  source: /note="Description of Artificial Sequence: Synthetic oligonucleotide"
ucuuauacuuaauaagcucuuuc

SEQ ID NO: 1911 - RNA, 21 nt, Artificial Sequence
  source: /note="Description of Artificial Sequence: Synthetic oligonucleotide"
uggaauauucuacuuuguuaa

SEQ ID NO: 1912 - RNA, 23 nt, Artificial Sequence
  source: /note="Description of Artificial Sequence: Synthetic oligonucleotide"
uuaacaaaguagaauauuccaac

SEQ ID NO: 1913 - RNA, 21 nt, Artificial Sequence
  source: /note="Description of Artificial Sequence: Synthetic oligonucleotide"
auguacagagguuauucuaua

SEQ ID NO: 1914 - RNA, 23 nt, Artificial Sequence
  source: /note="Description of Artificial Sequence: Synthetic oligonucleotide"
uauagaauaaccucuguacauug

SEQ ID NO: 1915 - RNA, 21 nt, Artificial Sequence
  source: /note="Description of Artificial Sequence: Synthetic oligonucleotide"
aucguaagagaacucuguaga

SEQ ID NO: 1916 - RNA, 23 nt, Artificial Sequence
  source: /note="Description of Artificial Sequence: Synthetic oligonucleotide"
ucuacagaguucucuuacgauuc

SEQ ID NO: 1917 - RNA, 21 nt, Artificial Sequence
  source: /note="Description of Artificial Sequence: Synthetic oligonucleotide"
caucuguuggaauauucuaca

SEQ ID NO: 1918 - RNA, 23 nt, Artificial Sequence
  source: /note="Description of Artificial Sequence: Synthetic oligonucleotide"
uguagaauauuccaacagauggg

SEQ ID NO: 1919 - RNA, 21 nt, Artificial Sequence
  source: /note="Description of Artificial Sequence: Synthetic oligonucleotide"
gucuuuacuggaaucuuugca

SEQ ID NO: 1920 - RNA, 23 nt, Artificial Sequence
  source: /note="Description of Artificial Sequence: Synthetic oligonucleotide"
ugcaaagauuccaguaaagacca

SEQ ID NO: 1921 - RNA, 21 nt, Artificial Sequence
  source: /note="Description of Artificial Sequence: Synthetic oligonucleotide"
caacacaauuucuucuuagca

SEQ ID NO: 1922 - RNA, 23 nt, Artificial Sequence
  source: /note="Description of Artificial Sequence: Synthetic oligonucleotide"
ugcuaagaagaaauuguguuguu

SEQ ID NO: 1923 - RNA, 21 nt, Artificial Sequence
  source: /note="Description of Artificial Sequence: Synthetic oligonucleotide"
uggauucucuucguucacaga

SEQ ID NO: 1924 - RNA, 23 nt, Artificial Sequence
  source: /note="Description of Artificial Sequence: Synthetic oligonucleotide"
ucugugaacgaagagaauccauc

SEQ ID NO: 1925 - RNA, 21 nt, Artificial Sequence
  source: /note="Description of Artificial Sequence: Synthetic oligonucleotide"
guauguuucuagcugauuuga

SEQ ID NO: 1926 - RNA, 23 nt, Artificial Sequence
  source: /note="Description of Artificial Sequence: Synthetic oligonucleotide"
ucaaaucagcuagaaacauaccu

SEQ ID NO: 1927 - RNA, 21 nt, Artificial Sequence
  source: /note="Description of Artificial Sequence: Synthetic oligonucleotide"
ccuuccugauaugcaguuaga

SEQ ID NO: 1928 - RNA, 23 nt, Artificial Sequence
  source: /note="Description of Artificial Sequence: Synthetic oligonucleotide"
ucuaacugcauaucaggaaggau

SEQ ID NO: 1929 - RNA, 21 nt, Artificial Sequence
  source: /note="Description of Artificial Sequence: Synthetic oligonucleotide"
ggagauggauucucuucguua

SEQ ID NO: 1930 - RNA, 23 nt, Artificial Sequence
  source: /note="Description of Artificial Sequence: Synthetic oligonucleotide"
uaacgaagagaauccaucucccc

SEQ ID NO: 1931 - RNA, 21 nt, Artificial Sequence
  source: /note="Description of Artificial Sequence: Synthetic oligonucleotide"
guagaaaacuuuuacaucuga

SEQ ID NO: 1932 - RNA, 23 nt, Artificial Sequence
  source: /note="Description of Artificial Sequence: Synthetic oligonucleotide"
ucagauguaaaaguuuucuacau

SEQ ID NO: 1933 - RNA, 21 nt, Artificial Sequence
  source: /note="Description of Artificial Sequence: Synthetic oligonucleotide"
agcgugcuuauagacguuaca

SEQ ID NO: 1934 - RNA, 23 nt, Artificial Sequence
  source: /note="Description of Artificial Sequence: Synthetic oligonucleotide"
uguaacgucuauaagcacgcuga

SEQ ID NO: 1935 - RNA, 21 nt, Artificial Sequence
  source: /note="Description of Artificial Sequence: Synthetic oligonucleotide"
guuucuagcugauuugauuga

SEQ ID NO: 1936 - RNA, 23 nt, Artificial Sequence
  source: /note="Description of Artificial Sequence: Synthetic oligonucleotide"
ucaaucaaaucagcuagaaacau

SEQ ID NO: 1937 - RNA, 21 nt, Artificial Sequence
  source: /note="Description of Artificial Sequence: Synthetic oligonucleotide"
gcccaaaauacugauaauaga

SEQ ID NO: 1938 - RNA, 23 nt, Artificial Sequence
  source: /note="Description of Artificial Sequence: Synthetic oligonucleotide"
ucuauuaucaguauuuugggcag

SEQ ID NO: 1939 - RNA, 21 nt, Artificial Sequence
  source: /note="Description of Artificial Sequence: Synthetic oligonucleotide"
uuuguccuaaucuacguauaa

SEQ ID NO: 1940 - RNA, 23 nt, Artificial Sequence
  source: /note="Description of Artificial Sequence: Synthetic oligonucleotide"
uuauacguagauuaggacaaaug

SEQ ID NO: 1941 - RNA, 21 nt, Artificial Sequence
  source: /note="Description of Artificial Sequence: Synthetic oligonucleotide"
uaaucgcugaacuuauuacaa

SEQ ID NO: 1942 - RNA, 23 nt, Artificial Sequence
  source: /note="Description of Artificial Sequence: Synthetic oligonucleotide"
uuguaauaaguucagcgauuaua

SEQ ID NO: 1943 - RNA, 21 nt, Artificial Sequence
  source: /note="Description of Artificial Sequence: Synthetic oligonucleotide"
uuugaauucaaucuaccguua

SEQ ID NO: 1944 - RNA, 23 nt, Artificial Sequence
  source: /note="Description of Artificial Sequence: Synthetic oligonucleotide"
uaacgguagauugaauucaaauu

SEQ ID NO: 1945 - RNA, 21 nt, Artificial Sequence
  source: /note="Description of Artificial Sequence: Synthetic oligonucleotide"
cucuuuugaggaagucuauga

SEQ ID NO: 1946 - RNA, 23 nt, Artificial Sequence
  source: /note="Description of Artificial Sequence: Synthetic oligonucleotide"
ucauagacuuccucaaaagaguu

SEQ ID NO: 1947 - RNA, 21 nt, Artificial Sequence
  source: /note="Description of Artificial Sequence: Synthetic oligonucleotide"
agcugauuugauugaaacgua

SEQ ID NO: 1948 - RNA, 23 nt, Artificial Sequence
  source: /note="Description of Artificial Sequence: Synthetic oligonucleotide"
uacguuucaaucaaaucagcuag

SEQ ID NO: 1949 - RNA, 21 nt, Artificial Sequence
  source: /note="Description of Artificial Sequence: Synthetic oligonucleotide"
cuuuauaccaucuuagguuca

SEQ ID NO: 1950 - RNA, 23 nt, Artificial Sequence
  source: /note="Description of Artificial Sequence: Synthetic oligonucleotide"
ugaaccuaagaugguauaaagaa

SEQ ID NO: 1951 - RNA, 21 nt, Artificial Sequence
  source: /note="Description of Artificial Sequence: Synthetic oligonucleotide"
uugcaagccucuuaugugaga

SEQ ID NO: 1952 - RNA, 23 nt, Artificial Sequence
  source: /note="Description of Artificial Sequence: Synthetic oligonucleotide"
ucucacauaagaggcuugcaacc

SEQ ID NO: 1953 - RNA, 21 nt, Artificial Sequence
  source: /note="Description of Artificial Sequence: Synthetic oligonucleotide"
uuauugcaucacuuguauaca

SEQ ID NO: 1954 - RNA, 23 nt, Artificial Sequence
  source: /note="Description of Artificial Sequence: Synthetic oligonucleotide"
uguauacaagugaugcaauaaau

SEQ ID NO: 1955 - RNA, 21 nt, Artificial Sequence
  source: /note="Description of Artificial Sequence: Synthetic oligonucleotide"
uuucacaggauuguaauuaga

SEQ ID NO: 1956 - RNA, 23 nt, Artificial Sequence
  source: /note="Description of Artificial Sequence: Synthetic oligonucleotide"
ucuaauuacaauccugugaaaag

SEQ ID NO: 1957 - RNA, 21 nt, Artificial Sequence
  source: /note="Description of Artificial Sequence: Synthetic oligonucleotide"
cuuuucacaggauuguaauua

SEQ ID NO: 1958 - RNA, 23 nt, Artificial Sequence
  source: /note="Description of Artificial Sequence: Synthetic oligonucleotide"
uaauuacaauccugugaaaagau

SEQ ID NO: 1959 - RNA, 21 nt, Artificial Sequence
  source: /note="Description of Artificial Sequence: Synthetic oligonucleotide"
cuguaggaauuauugauuaua

SEQ ID NO: 1960 - RNA, 23 nt, Artificial Sequence
  source: /note="Description of Artificial Sequence: Synthetic oligonucleotide"
uauaaucaauaauuccuacagag

SEQ ID NO: 1961 - RNA, 21 nt, Artificial Sequence
  source: /note="Description of Artificial Sequence: Synthetic oligonucleotide"
uuccugauaugcaguuaguua

SEQ ID NO: 1962 - RNA, 23 nt, Artificial Sequence
  source: /note="Description of Artificial Sequence: Synthetic oligonucleotide"
uaacuaacugcauaucaggaagg

SEQ ID NO: 1963 - RNA, 21 nt, Artificial Sequence
  source: /note="Description of Artificial Sequence: Synthetic oligonucleotide"
gcaagucaaguuccaaaucga

SEQ ID NO: 1964 - RNA, 23 nt, Artificial Sequence
  source: /note="Description of Artificial Sequence: Synthetic oligonucleotide"
ucgauuuggaacuugacuugcag

SEQ ID NO: 1965 - RNA, 21 nt, Artificial Sequence
  source: /note="Description of Artificial Sequence: Synthetic oligonucleotide"
ggaagaaagguucaugucuga

SEQ ID NO: 1966 - RNA, 23 nt, Artificial Sequence
  source: /note="Description of Artificial Sequence: Synthetic oligonucleotide"
ucagacaugaaccuuucuuccau

SEQ ID NO: 1967 - RNA, 21 nt, Artificial Sequence
  source: /note="Description of Artificial Sequence: Synthetic oligonucleotide"
aucuagggcuaaagauucuua

SEQ ID NO: 1968 - RNA, 23 nt, Artificial Sequence
  source: /note="Description of Artificial Sequence: Synthetic oligonucleotide"
uaagaaucuuuagcccuagauug

SEQ ID NO: 1969 - RNA, 21 nt, Artificial Sequence
  source: /note="Description of Artificial Sequence: Synthetic oligonucleotide"
uagcugauuugauugaaacga

SEQ ID NO: 1970 - RNA, 23 nt, Artificial Sequence
  source: /note="Description of Artificial Sequence: Synthetic oligonucleotide"
ucguuucaaucaaaucagcuaga

SEQ ID NO: 1971 - RNA, 21 nt, Artificial Sequence
  source: /note="Description of Artificial Sequence: Synthetic oligonucleotide"
cuuccugauaugcaguuagua

SEQ ID NO: 1972 - RNA, 23 nt, Artificial Sequence
  source: /note="Description of Artificial Sequence: Synthetic oligonucleotide"
uacuaacugcauaucaggaagga

SEQ ID NO: 1973 - RNA, 21 nt, Artificial Sequence
  source: /note="Description of Artificial Sequence: Synthetic oligonucleotide"
acugaugauucuuuaagaaua

SEQ ID NO: 1974 - RNA, 23 nt, Artificial Sequence
  source: /note="Description of Artificial Sequence: Synthetic oligonucleotide"
uauucuuaaagaaucaucagugc

SEQ ID NO: 1975 - RNA, 21 nt, Artificial Sequence
  source: /note="Description of Artificial Sequence: Synthetic oligonucleotide"
agacguuaccgcuuaaggcaa

SEQ ID NO: 1976 - RNA, 23 nt, Artificial Sequence
  source: /note="Description of Artificial Sequence: Synthetic oligonucleotide"
uugccuuaagcgguaacgucuau

SEQ ID NO: 1977 - RNA, 21 nt, Artificial Sequence
  source: /note="Description of Artificial Sequence: Synthetic oligonucleotide"
ucguggcuccuuguuuucuga

SEQ ID NO: 1978 - RNA, 23 nt, Artificial Sequence
  source: /note="Description of Artificial Sequence: Synthetic oligonucleotide"
ucagaaaacaaggagccacgaau

SEQ ID NO: 1979 - RNA, 21 nt, Artificial Sequence
  source: /note="Description of Artificial Sequence: Synthetic oligonucleotide"
ccuuucuucuuucauauccca

SEQ ID NO: 1980 - RNA, 23 nt, Artificial Sequence
  source: /note="Description of Artificial Sequence: Synthetic oligonucleotide"
ugggauaugaaagaagaaaggcu

SEQ ID NO: 1981 - RNA, 21 nt, Artificial Sequence
  source: /note="Description of Artificial Sequence: Synthetic oligonucleotide"
caucuuuucacaggauuguaa

SEQ ID NO: 1982 - RNA, 23 nt, Artificial Sequence
  source: /note="Description of Artificial Sequence: Synthetic oligonucleotide"
uuacaauccugugaaaagaugac

SEQ ID NO: 1983 - RNA, 21 nt, Artificial Sequence
  source: /note="Description of Artificial Sequence: Synthetic oligonucleotide"
cuguuggaaauagguuuugaa

SEQ ID NO: 1984 - RNA, 23 nt, Artificial Sequence
  source: /note="Description of Artificial Sequence: Synthetic oligonucleotide"
uucaaaaccuauuuccaacaggc

SEQ ID NO: 1985 - RNA, 21 nt, Artificial Sequence
  source: /note="Description of Artificial Sequence: Synthetic oligonucleotide"
gggagauggauucucuucgua

SEQ ID NO: 1986 - RNA, 23 nt, Artificial Sequence
  source: /note="Description of Artificial Sequence: Synthetic oligonucleotide"
uacgaagagaauccaucucccca

SEQ ID NO: 1987 - RNA, 21 nt, Artificial Sequence
  source: /note="Description of Artificial Sequence: Synthetic oligonucleotide"
uugaauucaaucuaccguuaa

SEQ ID NO: 1988 - RNA, 23 nt, Artificial Sequence
  source: /note="Description of Artificial Sequence: Synthetic oligonucleotide"
uuaacgguagauugaauucaaau

SEQ ID NO: 1989 - RNA, 21 nt, Artificial Sequence
  source: /note="Description of Artificial Sequence: Synthetic oligonucleotide"
ucaucuuaggcuauuugaaca

SEQ ID NO: 1990 - RNA, 23 nt, Artificial Sequence
  source: /note="Description of Artificial Sequence: Synthetic oligonucleotide"
uguucaaauagccuaagaugaau

SEQ ID NO: 1991 - RNA, 21 nt, Artificial Sequence
  source: /note="Description of Artificial Sequence: Synthetic oligonucleotide"
ugauucuuuaagaaucguaaa

SEQ ID NO: 1992 - RNA, 23 nt, Artificial Sequence
  source: /note="Description of Artificial Sequence: Synthetic oligonucleotide"
uuuacgauucuuaaagaaucauc

SEQ ID NO: 1993 - RNA, 21 nt, Artificial Sequence
  source: /note="Description of Artificial Sequence: Synthetic oligonucleotide"
guaauggacauuaguuaugaa

SEQ ID NO: 1994 - RNA, 23 nt, Artificial Sequence
  source: /note="Description of Artificial Sequence: Synthetic oligonucleotide"
uucauaacuaauguccauuacuu

SEQ ID NO: 1995 - RNA, 21 nt, Artificial Sequence
  source: /note="Description of Artificial Sequence: Synthetic oligonucleotide"
uugagacugacacauuguaaa

SEQ ID NO: 1996 - RNA, 23 nt, Artificial Sequence
  source: /note="Description of Artificial Sequence: Synthetic oligonucleotide"
uuuacaaugugucagucucaagu

SEQ ID NO: 1997 - RNA, 21 nt, Artificial Sequence
  source: /note="Description of Artificial Sequence: Synthetic oligonucleotide"
gaauucaaucuaccguuauua

SEQ ID NO: 1998 - RNA, 23 nt, Artificial Sequence
  source: /note="Description of Artificial Sequence: Synthetic oligonucleotide"
uaauaacgguagauugaauucaa

SEQ ID NO: 1999 - RNA, 21 nt, Artificial Sequence
  source: /note="Description of Artificial Sequence: Synthetic oligonucleotide"
augauucuuuaagaaucguaa

SEQ ID NO: 2000 - RNA, 23 nt, Artificial Sequence
  source: /note="Description of Artificial Sequence: Synthetic oligonucleotide"
uuacgauucuuaaagaaucauca

SEQ ID NO: 2001 - RNA, 21 nt, Artificial Sequence
  source: /note="Description of Artificial Sequence: Synthetic oligonucleotide"
agccuguuggaaauagguuua

SEQ ID NO: 2002 - RNA, 23 nt, Artificial Sequence
  source: /note="Description of Artificial Sequence: Synthetic oligonucleotide"
uaaaccuauuuccaacaggcuug

SEQ ID NO: 2003 - RNA, 21 nt, Artificial Sequence
  source: /note="Description of Artificial Sequence: Synthetic oligonucleotide"
cgugcuuauagacguuaccga

SEQ ID NO: 2004 - RNA, 23 nt, Artificial Sequence
  source: /note="Description of Artificial Sequence: Synthetic oligonucleotide"
ucgguaacgucuauaagcacgcu

SEQ ID NO: 2005 - RNA, 21 nt, Artificial Sequence
  source: /note="Description of Artificial Sequence: Synthetic oligonucleotide"
uuuaguggcaaacacucuuga

SEQ ID NO: 2006 - RNA, 23 nt, Artificial Sequence
  source: /note="Description of Artificial Sequence: Synthetic oligonucleotide"
ucaagaguguuugccacuaaagu

SEQ ID NO: 2007 - RNA, 21 nt, Artificial Sequence
  source: /note="Description of Artificial Sequence: Synthetic oligonucleotide"
accucucuuuccauguagaua

SEQ ID NO: 2008 - RNA, 23 nt, Artificial Sequence
  source: /note="Description of Artificial Sequence: Synthetic oligonucleotide"
uaucuacauggaaagagaggucu

SEQ ID NO: 2009 - RNA, 21 nt, Artificial Sequence
  source: /note="Description of Artificial Sequence: Synthetic oligonucleotide"
caacuuacuuuccuaaauuaa

SEQ ID NO: 2010 - RNA, 23 nt, Artificial Sequence
  source: /note="Description of Artificial Sequence: Synthetic oligonucleotide"
uuaauuuaggaaaguaaguuggu

SEQ ID NO: 2011 - RNA, 21 nt, Artificial Sequence
  source: /note="Description of Artificial Sequence: Synthetic oligonucleotide"
gcugaaccuaugaauuccgaa

SEQ ID NO: 2012 - RNA, 23 nt, Artificial Sequence
  source: /note="Description of Artificial Sequence: Synthetic oligonucleotide"
uucggaauucauagguucagccu

SEQ ID NO: 2013 - RNA, 21 nt, Artificial Sequence
  source: /note="Description of Artificial Sequence: Synthetic oligonucleotide"
uaucaaaauauucucgaagga

SEQ ID NO: 2014 - RNA, 23 nt, Artificial Sequence
  source: /note="Description of Artificial Sequence: Synthetic oligonucleotide"
uccuucgagaauauuuugauaaa

SEQ ID NO: 2015 - RNA, 21 nt, Artificial Sequence
  source: /note="Description of Artificial Sequence: Synthetic oligonucleotide"
acauccguuauuacuuugaga

SEQ ID NO: 2016 - RNA, 23 nt, Artificial Sequence
  source: /note="Description of Artificial Sequence: Synthetic oligonucleotide"
ucucaaaguaauaacggauguug

SEQ ID NO: 2017 - RNA, 21 nt, Artificial Sequence
  source: /note="Description of Artificial Sequence: Synthetic oligonucleotide"
agacauuuguccuaaucuaca

SEQ ID NO: 2018 - RNA, 23 nt, Artificial Sequence
  source: /note="Description of Artificial Sequence: Synthetic oligonucleotide"
uguagauuaggacaaaugucuca

SEQ ID NO: 2019 - RNA, 21 nt, Artificial Sequence
  source: /note="Description of Artificial Sequence: Synthetic oligonucleotide"
ugccacugaagaaaguacuga

SEQ ID NO: 2020 - RNA, 23 nt, Artificial Sequence
  source: /note="Description of Artificial Sequence: Synthetic oligonucleotide"
ucaguacuuucuucaguggcaac

SEQ ID NO: 2021 - RNA, 21 nt, Artificial Sequence
  source: /note="Description of Artificial Sequence: Synthetic oligonucleotide"
ucaucuuuucacaggauugua

SEQ ID NO: 2022 - RNA, 23 nt, Artificial Sequence
  source: /note="Description of Artificial Sequence: Synthetic oligonucleotide"
uacaauccugugaaaagaugaca

SEQ ID NO: 2023 - RNA, 21 nt, Artificial Sequence
  source: /note="Description of Artificial Sequence: Synthetic oligonucleotide"
cggacuugguuaccuaucuca

SEQ ID NO: 2024 - RNA, 23 nt, Artificial Sequence
  source: /note="Description of Artificial Sequence: Synthetic oligonucleotide"
ugagauagguaaccaaguccgac

SEQ ID NO: 2025 - RNA, 21 nt, Artificial Sequence
  source: /note="Description of Artificial Sequence: Synthetic oligonucleotide"
cucuuuccauguagauuacua

SEQ ID NO: 2026 - RNA, 23 nt, Artificial Sequence
  source: /note="Description of Artificial Sequence: Synthetic oligonucleotide"
uaguaaucuacauggaaagagag

SEQ ID NO: 2027 - RNA, 21 nt, Artificial Sequence
  source: /note="Description of Artificial Sequence: Synthetic oligonucleotide"
acaacuuucacuaauuugcua

SEQ ID NO: 2028 - RNA, 23 nt, Artificial Sequence
  source: /note="Description of Artificial Sequence: Synthetic oligonucleotide"
uagcaaauuagugaaaguuguuu

SEQ ID NO: 2029 - RNA, 21 nt, Artificial Sequence
  source: /note="Description of Artificial Sequence: Synthetic oligonucleotide"
uacaacauccguuauuacuua

SEQ ID NO: 2030 - RNA, 23 nt, Artificial Sequence
  source: /note="Description of Artificial Sequence: Synthetic oligonucleotide"
uaaguaauaacggauguuguaaa

SEQ ID NO: 2031 - RNA, 21 nt, Artificial Sequence
  source: /note="Description of Artificial Sequence: Synthetic oligonucleotide"
aaugucggacuugguuaccua

SEQ ID NO: 2032 - RNA, 23 nt, Artificial Sequence
  source: /note="Description of Artificial Sequence: Synthetic oligonucleotide"
uagguaaccaaguccgacauuau

SEQ ID NO: 2033 - RNA, 21 nt, Artificial Sequence
  source: /note="Description of Artificial Sequence: Synthetic oligonucleotide"
acaacauccguuauuacuuua

SEQ ID NO: 2034 - RNA, 23 nt, Artificial Sequence
  source: /note="Description of Artificial Sequence: Synthetic oligonucleotide"
uaaaguaauaacggauguuguaa

SEQ ID NO: 2035 - RNA, 21 nt, Artificial Sequence
  source: /note="Description of Artificial Sequence: Synthetic oligonucleotide"
cuucuuagccuuguuuaggca

SEQ ID NO: 2036 - RNA, 23 nt, Artificial Sequence
  source: /note="Description of Artificial Sequence: Synthetic oligonucleotide"
ugccuaaacaaggcuaagaaggc

SEQ ID NO: 2037 - RNA, 21 nt, Artificial Sequence
  source: /note="Description of Artificial Sequence: Synthetic oligonucleotide"
acacagguagaauguaguuua

SEQ ID NO: 2038 - RNA, 23 nt, Artificial Sequence
  source: /note="Description of Artificial Sequence: Synthetic oligonucleotide"
uaaacuacauucuaccuguguag

SEQ ID NO: 2039 - RNA, 21 nt, Artificial Sequence
  source: /note="Description of Artificial Sequence: Synthetic oligonucleotide"
cugaaccuaugaauuccgaua

SEQ ID NO: 2040 - RNA, 23 nt, Artificial Sequence
  source: /note="Description of Artificial Sequence: Synthetic oligonucleotide"
uaucggaauucauagguucagcc

SEQ ID NO: 2041 - RNA, 21 nt, Artificial Sequence
  source: /note="Description of Artificial Sequence: Synthetic oligonucleotide"
auucuuuaagaaucguaagaa

SEQ ID NO: 2042 - RNA, 23 nt, Artificial Sequence
  source: /note="Description of Artificial Sequence: Synthetic oligonucleotide"
uucuuacgauucuuaaagaauca

SEQ ID NO: 2043 - RNA, 21 nt, Artificial Sequence
  source: /note="Description of Artificial Sequence: Synthetic oligonucleotide"
gauucuuuaagaaucguaaga

SEQ ID NO: 2044 - RNA, 23 nt, Artificial Sequence
  source: /note="Description of Artificial Sequence: Synthetic oligonucleotide"
ucuuacgauucuuaaagaaucau

SEQ ID NO: 2045 - RNA, 21 nt, Artificial Sequence
  source: /note="Description of Artificial Sequence: Synthetic oligonucleotide"
guuucaggaaugucuacuuga

SEQ ID NO: 2046 - RNA, 23 nt, Artificial Sequence
  source: /note="Description of Artificial Sequence: Synthetic oligonucleotide"
ucaaguagacauuccugaaacaa

SEQ ID NO: 2047 - RNA, 21 nt, Artificial Sequence
  source: /note="Description of Artificial Sequence: Synthetic oligonucleotide"
uauagaaacaaagauuuauga

SEQ ID NO: 2048 - RNA, 23 nt, Artificial Sequence
  source: /note="Description of Artificial Sequence: Synthetic oligonucleotide"
ucauaaaucuuuguuucuauagg

SEQ ID NO: 2049 - RNA, 21 nt, Artificial Sequence
  source: /note="Description of Artificial Sequence: Synthetic oligonucleotide"
uuacaacauccguuauuacua

SEQ ID NO: 2050 - RNA, 23 nt, Artificial Sequence
  source: /note="Description of Artificial Sequence: Synthetic oligonucleotide"
uaguaauaacggauguuguaaaa

SEQ ID NO: 2051 - RNA, 21 nt, Artificial Sequence
  source: /note="Description of Artificial Sequence: Synthetic oligonucleotide"
uuucaggaaugucuacuugua

SEQ ID NO: 2052 - RNA, 23 nt, Artificial Sequence
  source: /note="Description of Artificial Sequence: Synthetic oligonucleotide"
uacaaguagacauuccugaaaca

SEQ ID NO: 2053 - RNA, 21 nt, Artificial Sequence
  source: /note="Description of Artificial Sequence: Synthetic oligonucleotide"
gauaauagucucuuaaacuca

SEQ ID NO: 2054 - RNA, 23 nt, Artificial Sequence
  source: /note="Description of Artificial Sequence: Synthetic oligonucleotide"
ugaguuuaagagacuauuaucag

SEQ ID NO: 2055 - RNA, 21 nt, Artificial Sequence
  source: /note="Description of Artificial Sequence: Synthetic oligonucleotide"
agagguuauucuauauuuuga

SEQ ID NO: 2056 - RNA, 23 nt, Artificial Sequence
  source: /note="Description of Artificial Sequence: Synthetic oligonucleotide"
ucaaaauauagaauaaccucugu

SEQ ID NO: 2057 - RNA, 21 nt, Artificial Sequence
  source: /note="Description of Artificial Sequence: Synthetic oligonucleotide"
ucacaaccacacuaaaacgga

SEQ ID NO: 2058 - RNA, 23 nt, Artificial Sequence
  source: /note="Description of Artificial Sequence: Synthetic oligonucleotide"
uccguuuuagugugguugugaug

SEQ ID NO: 2059 - RNA, 21 nt, Artificial Sequence
  source: /note="Description of Artificial Sequence: Synthetic oligonucleotide"
acacaauuucuucuuagcaua

SEQ ID NO: 2060 - RNA, 23 nt, Artificial Sequence
  source: /note="Description of Artificial Sequence: Synthetic oligonucleotide"
uaugcuaagaagaaauuguguug

SEQ ID NO: 2061 - RNA, 21 nt, Artificial Sequence
  source: /note="Description of Artificial Sequence: Synthetic oligonucleotide"
ucauccuggaaguucaguuga

SEQ ID NO: 2062 - RNA, 23 nt, Artificial Sequence
  source: /note="Description of Artificial Sequence: Synthetic oligonucleotide"
ucaacugaacuuccaggaugaac

SEQ ID NO: 2063 - RNA, 21 nt, Artificial Sequence
  source: /note="Description of Artificial Sequence: Synthetic oligonucleotide"
uugcaucagaaccaauuuaua

SEQ ID NO: 2064 - RNA, 23 nt, Artificial Sequence
  source: /note="Description of Artificial Sequence: Synthetic oligonucleotide"
uauaaauugguucugaugcaaug

SEQ ID NO: 2065 - RNA, 21 nt, Artificial Sequence
  source: /note="Description of Artificial Sequence: Synthetic oligonucleotide"
uucaucuuaggcuauuugaaa

SEQ ID NO: 2066 - RNA, 23 nt, Artificial Sequence
  source: /note="Description of Artificial Sequence: Synthetic oligonucleotide"
uuucaaauagccuaagaugaaug

SEQ ID NO: 2067 - RNA, 21 nt, Artificial Sequence
  source: /note="Description of Artificial Sequence: Synthetic oligonucleotide"
gauucuuuauaccaucuuaga

SEQ ID NO: 2068 - RNA, 23 nt, Artificial Sequence
  source: /note="Description of Artificial Sequence: Synthetic oligonucleotide"
ucuaagaugguauaaagaaucuu

SEQ ID NO: 2069 - RNA, 21 nt, Artificial Sequence
  source: /note="Description of Artificial Sequence: Synthetic oligonucleotide"
auaaucgcugaacuuauuaca

SEQ ID NO: 2070 - RNA, 23 nt, Artificial Sequence
  source: /note="Description of Artificial Sequence: Synthetic oligonucleotide"
uguaauaaguucagcgauuauaa

SEQ ID NO: 2071 - RNA, 21 nt, Artificial Sequence
  source: /note="Description of Artificial Sequence: Synthetic oligonucleotide"
auuuguccuaaucuacguaua

SEQ ID NO: 2072 - RNA, 23 nt, Artificial Sequence
  source: /note="Description of Artificial Sequence: Synthetic oligonucleotide"
uauacguagauuaggacaaaugu

SEQ ID NO: 2073 - RNA, 21 nt, Artificial Sequence
  source: /note="Description of Artificial Sequence: Synthetic oligonucleotide"
uuuuacaucugccuugucaua

SEQ ID NO: 2074 - RNA, 23 nt, Artificial Sequence
  source: /note="Description of Artificial Sequence: Synthetic oligonucleotide"
uaugacaaggcagauguaaaagu

SEQ ID NO: 2075 - RNA, 21 nt, Artificial Sequence
  source: /note="Description of Artificial Sequence: Synthetic oligonucleotide"
acauuuguccuaaucuacgua

SEQ ID NO: 2076 - RNA, 23 nt, Artificial Sequence
  source: /note="Description of Artificial Sequence: Synthetic oligonucleotide"
uacguagauuaggacaaaugucu

SEQ ID NO: 2077 - RNA, 21 nt, Artificial Sequence
  source: /note="Description of Artificial Sequence: Synthetic oligonucleotide"
uguuuagucauccuuucgcua

SEQ ID NO: 2078 - RNA, 23 nt, Artificial Sequence
  source: /note="Description of Artificial Sequence: Synthetic oligonucleotide"
uagcgaaaggaugacuaaacaau

SEQ ID NO: 2079 - RNA, 21 nt, Artificial Sequence
  source: /note="Description of Artificial Sequence: Synthetic oligonucleotide"
ucuccuuaaaauucuaugaua

SEQ ID NO: 2080 - RNA, 23 nt, Artificial Sequence
  source: /note="Description of Artificial Sequence: Synthetic oligonucleotide"
uaucauagaauuuuaaggagaag

SEQ ID NO: 2081 - RNA, 21 nt, Artificial Sequence
  source: /note="Description of Artificial Sequence: Synthetic oligonucleotide"
acaggauuguaauuagucuua

SEQ ID NO: 2082 - RNA, 23 nt, Artificial Sequence
  source: /note="Description of Artificial Sequence: Synthetic oligonucleotide"
uaagacuaauuacaauccuguga

SEQ ID NO: 2083 - RNA, 21 nt, Artificial Sequence
  source: /note="Description of Artificial Sequence: Synthetic oligonucleotide"
uagguucauucaucuuaggca

SEQ ID NO: 2084 - RNA, 23 nt, Artificial Sequence
  source: /note="Description of Artificial Sequence: Synthetic oligonucleotide"
ugccuaagaugaaugaaccuaag

SEQ ID NO: 2085 - RNA, 21 nt, Artificial Sequence
  source: /note="Description of Artificial Sequence: Synthetic oligonucleotide"
aacaacuuucacuaauuugca

SEQ ID NO: 2086 - RNA, 23 nt, Artificial Sequence
  source: /note="Description of Artificial Sequence: Synthetic oligonucleotide"
ugcaaauuagugaaaguuguuuu

SEQ ID NO: 2087 - RNA, 21 nt, Artificial Sequence
  source: /note="Description of Artificial Sequence: Synthetic oligonucleotide"
aagccuuugauauuaguauca

SEQ ID NO: 2088 - RNA, 23 nt, Artificial Sequence
  source: /note="Description of Artificial Sequence: Synthetic oligonucleotide"
ugauacuaauaucaaaggcuuga

SEQ ID NO: 2089 - RNA, 21 nt, Artificial Sequence
  source: /note="Description of Artificial Sequence: Synthetic oligonucleotide"
cuuucuucuuucauaucccua

SEQ ID NO: 2090 - RNA, 23 nt, Artificial Sequence
  source: /note="Description of Artificial Sequence: Synthetic oligonucleotide"
uagggauaugaaagaagaaaggc

SEQ ID NO: 2091 - RNA, 21 nt, Artificial Sequence
  source: /note="Description of Artificial Sequence: Synthetic oligonucleotide"
ucacaggauuguaauuaguca

SEQ ID NO: 2092 - RNA, 23 nt, Artificial Sequence
  source: /note="Description of Artificial Sequence: Synthetic oligonucleotide"
ugacuaauuacaauccugugaaa

SEQ ID NO: 2093 - RNA, 21 nt, Artificial Sequence
  source: /note="Description of Artificial Sequence: Synthetic oligonucleotide"
uugcccuuaugaauguuagua

SEQ ID NO: 2094 - RNA, 23 nt, Artificial Sequence
  source: /note="Description of Artificial Sequence: Synthetic oligonucleotide"
uacuaacauucauaagggcaaaa

SEQ ID NO: 2095 - RNA, 21 nt, Artificial Sequence
  source: /note="Description of Artificial Sequence: Synthetic oligonucleotide"
caucagaaccaauuuauauga

SEQ ID NO: 2096 - RNA, 23 nt, Artificial Sequence
  source: /note="Description of Artificial Sequence: Synthetic oligonucleotide"
ucauauaaauugguucugaugca

SEQ ID NO: 2097 - RNA, 21 nt, Artificial Sequence
  source: /note="Description of Artificial Sequence: Synthetic oligonucleotide"
auucaaucuaccguuauuuca

SEQ ID NO: 2098 - RNA, 23 nt, Artificial Sequence
  source: /note="Description of Artificial Sequence: Synthetic oligonucleotide"
ugaaauaacgguagauugaauuc

SEQ ID NO: 2099 - RNA, 21 nt, Artificial Sequence
  source: /note="Description of Artificial Sequence: Synthetic oligonucleotide"
uuucgcuguaagcaaaguuga

SEQ ID NO: 2100 - RNA, 23 nt, Artificial Sequence
  source: /note="Description of Artificial Sequence: Synthetic oligonucleotide"
ucaacuuugcuuacagcgaaagg

SEQ ID NO: 2101 - RNA, 21 nt, Artificial Sequence
  source: /note="Description of Artificial Sequence: Synthetic oligonucleotide"
auuguuuagucauccuuucga

SEQ ID NO: 2102 - RNA, 23 nt, Artificial Sequence
  source: /note="Description of Artificial Sequence: Synthetic oligonucleotide"
ucgaaaggaugacuaaacaauac

SEQ ID NO: 2103 - RNA, 21 nt, Artificial Sequence
  source: /note="Description of Artificial Sequence: Synthetic oligonucleotide"
gagacauuuguccuaaucuaa

SEQ ID NO: 2104 - RNA, 23 nt, Artificial Sequence
  source: /note="Description of Artificial Sequence: Synthetic oligonucleotide"
uuagauuaggacaaaugucucaa

SEQ ID NO: 2105 - RNA, 21 nt, Artificial Sequence
  source: /note="Description of Artificial Sequence: Synthetic oligonucleotide"
uugccaacuugcucucuugca

SEQ ID NO: 2106 - RNA, 23 nt, Artificial Sequence
  source: /note="Description of Artificial Sequence: Synthetic oligonucleotide"
ugcaagagagcaaguuggcaaga

SEQ ID NO: 2107 - RNA, 21 nt, Artificial Sequence
  source: /note="Description of Artificial Sequence: Synthetic oligonucleotide"
auguauauuugaccuagugaa

SEQ ID NO: 2108 - RNA, 23 nt, Artificial Sequence
  source: /note="Description of Artificial Sequence: Synthetic oligonucleotide"
uucacuaggucaaauauacaucc

SEQ ID NO: 2109 - RNA, 21 nt, Artificial Sequence
  source: /note="Description of Artificial Sequence: Synthetic oligonucleotide"
cacaggauuguaauuagucua

SEQ ID NO: 2110 - RNA, 23 nt, Artificial Sequence
  source: /note="Description of Artificial Sequence: Synthetic oligonucleotide"
uagacuaauuacaauccugugaa

SEQ ID NO: 2111 - RNA, 21 nt, Artificial Sequence
  source: /note="Description of Artificial Sequence: Synthetic oligonucleotide"
gauguuugacagguucgugua

SEQ ID NO: 2112 - RNA, 23 nt, Artificial Sequence
  source: /note="Description of Artificial Sequence: Synthetic oligonucleotide"
uacacgaaccugucaaacaucuu

SEQ ID NO: 2113 - RNA, 21 nt, Artificial Sequence
  source: /note="Description of Artificial Sequence: Synthetic oligonucleotide"
uagcuguagacaucuaguuua

SEQ ID NO: 2114 - RNA, 23 nt, Artificial Sequence
  source: /note="Description of Artificial Sequence: Synthetic oligonucleotide"
uaaacuagaugucuacagcuaau

SEQ ID NO: 2115 - RNA, 21 nt, Artificial Sequence
  source: /note="Description of Artificial Sequence: Synthetic oligonucleotide"
uacacagguagaauguaguua

SEQ ID NO: 2116 - RNA, 23 nt, Artificial Sequence
  source: /note="Description of Artificial Sequence: Synthetic oligonucleotide"
uaacuacauucuaccuguguagc

SEQ ID NO: 2117 - RNA, 21 nt, Artificial Sequence
  source: /note="Description of Artificial Sequence: Synthetic oligonucleotide"
agucucuuaaacucuuuugua

SEQ ID NO: 2118 - RNA, 23 nt, Artificial Sequence
  source: /note="Description of Artificial Sequence: Synthetic oligonucleotide"
uacaaaagaguuuaagagacuau

SEQ ID NO: 2119 - RNA, 21 nt, Artificial Sequence
  source: /note="Description of Artificial Sequence: Synthetic oligonucleotide"
aucacaaccacacuaaaacga

SEQ ID NO: 2120 - RNA, 23 nt, Artificial Sequence
  source: /note="Description of Artificial Sequence: Synthetic oligonucleotide"
ucguuuuagugugguugugaugg

SEQ ID NO: 2121 - RNA, 21 nt, Artificial Sequence
  source: /note="Description of Artificial Sequence: Synthetic oligonucleotide"
cauuuguccuaaucuacguaa

SEQ ID NO: 2122 - RNA, 23 nt, Artificial Sequence
  source: /note="Description of Artificial Sequence: Synthetic oligonucleotide"
uuacguagauuaggacaaauguc

SEQ ID NO: 2123 - RNA, 21 nt, Artificial Sequence
  source: /note="Description of Artificial Sequence: Synthetic oligonucleotide"
cugccaaguuaacauagagua

SEQ ID NO: 2124 - RNA, 23 nt, Artificial Sequence
  source: /note="Description of Artificial Sequence: Synthetic oligonucleotide"
uacucuauguuaacuuggcagca

SEQ ID NO: 2125 - RNA, 21 nt, Artificial Sequence
  source: /note="Description of Artificial Sequence: Synthetic oligonucleotide"
auuagcuguagacaucuagua

SEQ ID NO: 2126 - RNA, 23 nt, Artificial Sequence
  source: /note="Description of Artificial Sequence: Synthetic oligonucleotide"
uacuagaugucuacagcuaaugc

SEQ ID NO: 2127 - RNA, 21 nt, Artificial Sequence
  source: /note="Description of Artificial Sequence: Synthetic oligonucleotide"
gucucuuaaacucuuuuguca

SEQ ID NO: 2128 - RNA, 23 nt, Artificial Sequence
  source: /note="Description of Artificial Sequence: Synthetic oligonucleotide"
ugacaaaagaguuuaagagacua

SEQ ID NO: 2129 - RNA, 21 nt, Artificial Sequence
  source: /note="Description of Artificial Sequence: Synthetic oligonucleotide"
gacauuuguccuaaucuacga

SEQ ID NO: 2130 - RNA, 23 nt, Artificial Sequence
  source: /note="Description of Artificial Sequence: Synthetic oligonucleotide"
ucguagauuaggacaaaugucuc

SEQ ID NO: 2131 - RNA, 21 nt, Artificial Sequence
  source: /note="Description of Artificial Sequence: Synthetic oligonucleotide"
uucuuuauaccaucuuaggua

SEQ ID NO: 2132 - RNA, 23 nt, Artificial Sequence
  source: /note="Description of Artificial Sequence: Synthetic oligonucleotide"
uaccuaagaugguauaaagaauc

SEQ ID NO: 2133 - RNA, 21 nt, Artificial Sequence
  source: /note="Description of Artificial Sequence: Synthetic oligonucleotide"
cacagguagaauguaguuuua

SEQ ID NO: 2134 - RNA, 23 nt, Artificial Sequence
  source: /note="Description of Artificial Sequence: Synthetic oligonucleotide"
uaaaacuacauucuaccugugua

SEQ ID NO: 2135 - RNA, 21 nt, Artificial Sequence
  source: /note="Description of Artificial Sequence: Synthetic oligonucleotide"
auguagauuacuguuuguaca

SEQ ID NO: 2136 - RNA, 23 nt, Artificial Sequence
  source: /note="Description of Artificial Sequence: Synthetic oligonucleotide"
uguacaaacaguaaucuacaugg

SEQ ID NO: 2137 - RNA, 21 nt, Artificial Sequence
  source: /note="Description of Artificial Sequence: Synthetic oligonucleotide"
ucacuuguauacaaucccgua

SEQ ID NO: 2138 - RNA, 23 nt, Artificial Sequence
  source: /note="Description of Artificial Sequence: Synthetic oligonucleotide"
uacgggauuguauacaagugaug

SEQ ID NO: 2139 - RNA, 21 nt, Artificial Sequence
  source: /note="Description of Artificial Sequence: Synthetic oligonucleotide"
auucaucuuaggcuauuugaa

SEQ ID NO: 2140 - RNA, 23 nt, Artificial Sequence
  source: /note="Description of Artificial Sequence: Synthetic oligonucleotide"
uucaaauagccuaagaugaauga

SEQ ID NO: 2141 - RNA, 21 nt, Artificial Sequence
  source: /note="Description of Artificial Sequence: Synthetic oligonucleotide"
cauucaucuuaggcuauuuga

SEQ ID NO: 2142 - RNA, 23 nt, Artificial Sequence
  source: /note="Description of Artificial Sequence: Synthetic oligonucleotide"
ucaaauagccuaagaugaaugaa

SEQ ID NO: 2143 - RNA, 21 nt, Artificial Sequence
  source: /note="Description of Artificial Sequence: Synthetic oligonucleotide"
agagcuuauuaaguauaagca

SEQ ID NO: 2144 - RNA, 23 nt, Artificial Sequence
  source: /note="Description of Artificial Sequence: Synthetic oligonucleotide"
ugcuuauacuuaauaagcucuuu

SEQ ID NO: 2145 - RNA, 21 nt, Artificial Sequence
  source: /note="Description of Artificial Sequence: Synthetic oligonucleotide"
ugaugauucuuuaagaaucga

SEQ ID NO: 2146 - RNA, 23 nt, Artificial Sequence
  source: /note="Description of Artificial Sequence: Synthetic oligonucleotide"
ucgauucuuaaagaaucaucagu

SEQ ID NO: 2147 - RNA, 21 nt, Artificial Sequence
  source: /note="Description of Artificial Sequence: Synthetic oligonucleotide"
caacagauguuagaccgucua

SEQ ID NO: 2148 - RNA, 23 nt, Artificial Sequence
  source: /note="Description of Artificial Sequence: Synthetic oligonucleotide"
uagacggucuaacaucuguugaa

SEQ ID NO: 2149 - RNA, 21 nt, Artificial Sequence
  source: /note="Description of Artificial Sequence: Synthetic oligonucleotide"
uuuguagaucuugcaauuaca

SEQ ID NO: 2150 - RNA, 23 nt, Artificial Sequence
  source: /note="Description of Artificial Sequence: Synthetic oligonucleotide"
uguaauugcaagaucuacaaaag

SEQ ID NO: 2151 - RNA, 21 nt, Artificial Sequence
  source: /note="Description of Artificial Sequence: Synthetic oligonucleotide"
uucuguguaggagaauucaca

SEQ ID NO: 2152 - RNA, 23 nt, Artificial Sequence
  source: /note="Description of Artificial Sequence: Synthetic oligonucleotide"
ugugaauucuccuacacagaagc

SEQ ID NO: 2153 - RNA, 21 nt, Artificial Sequence
  source: /note="Description of Artificial Sequence: Synthetic oligonucleotide"
augugaaacaaaccuuacgua

SEQ ID NO: 2154 - RNA, 23 nt, Artificial Sequence
  source: /note="Description of Artificial Sequence: Synthetic oligonucleotide"
uacguaagguuuguuucacauaa

SEQ ID NO: 2155 - RNA, 21 nt, Artificial Sequence
  source: /note="Description of Artificial Sequence: Synthetic oligonucleotide"
uguaggagaauucacuuuuca

SEQ ID NO: 2156 - RNA, 23 nt, Artificial Sequence
  source: /note="Description of Artificial Sequence: Synthetic oligonucleotide"
ugaaaagugaauucuccuacaca

SEQ ID NO: 2157 - RNA, 21 nt, Artificial Sequence
  source: /note="Description of Artificial Sequence: Synthetic oligonucleotide"
uaugugaaacaaaccuuacga

SEQ ID NO: 2158 - RNA, 23 nt, Artificial Sequence
  source: /note="Description of Artificial Sequence: Synthetic oligonucleotide"
ucguaagguuuguuucacauaau

SEQ ID NO: 2159 - RNA, 21 nt, Artificial Sequence
  source: /note="Description of Artificial Sequence: Synthetic oligonucleotide"
agcauaaauguuuucgaaaua

SEQ ID NO: 2160 - RNA, 23 nt, Artificial Sequence
  source: /note="Description of Artificial Sequence: Synthetic oligonucleotide"
uauuucgaaaacauuuaugcuuc

SEQ ID NO: 2161 - RNA, 21 nt, Artificial Sequence
  source: /note="Description of Artificial Sequence: Synthetic oligonucleotide"
gaucuucuuugucguagugaa

SEQ ID NO: 2162 - RNA, 23 nt, Artificial Sequence
  source: /note="Description of Artificial Sequence: Synthetic oligonucleotide"
uucacuacgacaaagaagaucau

SEQ ID NO: 2163 - RNA, 21 nt, Artificial Sequence
  source: /note="Description of Artificial Sequence: Synthetic oligonucleotide"
ggcguuguaguuccuaucuca

SEQ ID NO: 2164 - RNA, 23 nt, Artificial Sequence
  source: /note="Description of Artificial Sequence: Synthetic oligonucleotide"
ugagauaggaacuacaacgccuu

SEQ ID NO: 2165 - RNA, 21 nt, Artificial Sequence
  source: /note="Description of Artificial Sequence: Synthetic oligonucleotide"
aucuucuuugucguagugaua

SEQ ID NO: 2166 - RNA, 23 nt, Artificial Sequence
  source: /note="Description of Artificial Sequence: Synthetic oligonucleotide"
uaucacuacgacaaagaagauca

SEQ ID NO: 2167 - RNA, 21 nt, Artificial Sequence
  source: /note="Description of Artificial Sequence: Synthetic oligonucleotide"
ugguuucagcacagauucaga

SEQ ID NO: 2168 - RNA, 23 nt, Artificial Sequence
  source: /note="Description of Artificial Sequence: Synthetic oligonucleotide"
ucugaaucugugcugaaaccaca

SEQ ID NO: 2169 - RNA, 21 nt, Artificial Sequence
  source: /note="Description of Artificial Sequence: Synthetic oligonucleotide"
ugucgaguacacuuuuacuga

SEQ ID NO: 2170 - RNA, 23 nt, Artificial Sequence
  source: /note="Description of Artificial Sequence: Synthetic oligonucleotide"
ucaguaaaaguguacucgacauu

SEQ ID NO: 2171 - RNA, 21 nt, Artificial Sequence
  source: /note="Description of Artificial Sequence: Synthetic oligonucleotide"
aagcagaagaucugaauacua

SEQ ID NO: 2172 - RNA, 23 nt, Artificial Sequence
  source: /note="Description of Artificial Sequence: Synthetic oligonucleotide"
uaguauucagaucuucugcuugu

SEQ ID NO: 2173 - RNA, 21 nt, Artificial Sequence
  source: /note="Description of Artificial Sequence: Synthetic oligonucleotide"
caaguguuccuacugucauga

SEQ ID NO: 2174 - RNA, 23 nt, Artificial Sequence
  source: /note="Description of Artificial Sequence: Synthetic oligonucleotide"
ucaugacaguaggaacacuugaa

SEQ ID NO: 2175 - RNA, 21 nt, Artificial Sequence
  source: /note="Description of Artificial Sequence: Synthetic oligonucleotide"
augcugagaaauugucgaaaa

SEQ ID NO: 2176 - RNA, 23 nt, Artificial Sequence
  source: /note="Description of Artificial Sequence: Synthetic oligonucleotide"
uuuucgacaauuucucagcaucu

SEQ ID NO: 2177 - RNA, 21 nt, Artificial Sequence
  source: /note="Description of Artificial Sequence: Synthetic oligonucleotide"
auguuucuagcugauuugaua

SEQ ID NO: 2178 - RNA, 23 nt, Artificial Sequence
  source: /note="Description of Artificial Sequence: Synthetic oligonucleotide"
uaucaaaucagcuagaaacauac

SEQ ID NO: 2179 - RNA, 21 nt, Artificial Sequence
  source: /note="Description of Artificial Sequence: Synthetic oligonucleotide"
gagauggauucucuucguuca

SEQ ID NO: 2180 - RNA, 23 nt, Artificial Sequence
  source: /note="Description of Artificial Sequence: Synthetic oligonucleotide"
ugaacgaagagaauccaucuccc

SEQ ID NO: 2181 - RNA, 21 nt, Artificial Sequence
  source: /note="Description of Artificial Sequence: Synthetic oligonucleotide"
uugugacuuuaaguuuaguga

SEQ ID NO: 2182 - RNA, 23 nt, Artificial Sequence
  source: /note="Description of Artificial Sequence: Synthetic oligonucleotide"
ucacuaaacuuaaagucacaaua

SEQ ID NO: 2183 - RNA, 21 nt, Artificial Sequence
  source: /note="Description of Artificial Sequence: Synthetic oligonucleotide"
augaucuucuuugucguagua

SEQ ID NO: 2184 - RNA, 23 nt, Artificial Sequence
  source: /note="Description of Artificial Sequence: Synthetic oligonucleotide"
uacuacgacaaagaagaucaugu

SEQ ID NO: 2185 - RNA, 21 nt, Artificial Sequence
  source: /note="Description of Artificial Sequence: Synthetic oligonucleotide"
aagggaaaacaaucuuccgua

SEQ ID NO: 2186 - RNA, 23 nt, Artificial Sequence
  source: /note="Description of Artificial Sequence: Synthetic oligonucleotide"
uacggaagauuguuuucccuuug

SEQ ID NO: 2187 - RNA, 21 nt, Artificial Sequence
  source: /note="Description of Artificial Sequence: Synthetic oligonucleotide"
cuucugaaacauccaaacuga

SEQ ID NO: 2188 - RNA, 23 nt, Artificial Sequence
  source: /note="Description of Artificial Sequence: Synthetic oligonucleotide"
ucaguuuggauguuucagaagaa

SEQ ID NO: 2189 - RNA, 21 nt, Artificial Sequence
  source: /note="Description of Artificial Sequence: Synthetic oligonucleotide"
uugcuauaggaaauuugguca

SEQ ID NO: 2190 - RNA, 23 nt, Artificial Sequence
  source: /note="Description of Artificial Sequence: Synthetic oligonucleotide"
ugaccaaauuuccuauagcaagu

SEQ ID NO: 2191 - RNA, 21 nt, Artificial Sequence
  source: /note="Description of Artificial Sequence: Synthetic oligonucleotide"
uauugugacuuuaaguuuaga

SEQ ID NO: 2192 - RNA, 23 nt, Artificial Sequence
  source: /note="Description of Artificial Sequence: Synthetic oligonucleotide"
ucuaaacuuaaagucacaauaag

SEQ ID NO: 2193 - RNA, 21 nt, Artificial Sequence
  source: /note="Description of Artificial Sequence: Synthetic oligonucleotide"
uuggcagaaacccugauuaua

SEQ ID NO: 2194 - RNA, 23 nt, Artificial Sequence
  source: /note="Description of Artificial Sequence: Synthetic oligonucleotide"
uauaaucaggguuucugccaauu

SEQ ID NO: 2195 - RNA, 21 nt, Artificial Sequence
  source: /note="Description of Artificial Sequence: Synthetic oligonucleotide"
acaugaucuucuuugucguaa

SEQ ID NO: 2196 - RNA, 23 nt, Artificial Sequence
  source: /note="Description of Artificial Sequence: Synthetic oligonucleotide"
uuacgacaaagaagaucauguag

SEQ ID NO: 2197 - RNA, 21 nt, Artificial Sequence
  source: /note="Description of Artificial Sequence: Synthetic oligonucleotide"
agcuugaaguaaaauuagaca

SEQ ID NO: 2198 - RNA, 23 nt, Artificial Sequence
  source: /note="Description of Artificial Sequence: Synthetic oligonucleotide"
ugucuaauuuuacuucaagcuua

SEQ ID NO: 2199 - RNA, 21 nt, Artificial Sequence
  source: /note="Description of Artificial Sequence: Synthetic oligonucleotide"
uccaaaucguuccgaauguua

SEQ ID NO: 2200 - RNA, 23 nt, Artificial Sequence
  source: /note="Description of Artificial Sequence: Synthetic oligonucleotide"
uaacauucggaacgauuuggaac

SEQ ID NO: 2201 - RNA, 21 nt, Artificial Sequence
  source: /note="Description of Artificial Sequence: Synthetic oligonucleotide"
aucugagacugaauuugccga

SEQ ID NO: 2202 - RNA, 23 nt, Artificial Sequence
  source: /note="Description of Artificial Sequence: Synthetic oligonucleotide"
ucggcaaauucagucucagaucc

SEQ ID NO: 2203 - RNA, 21 nt, Artificial Sequence
  source: /note="Description of Artificial Sequence: Synthetic oligonucleotide"
gcguuguaguuccuaucucca

SEQ ID NO: 2204 - RNA, 23 nt, Artificial Sequence
  source: /note="Description of Artificial Sequence: Synthetic oligonucleotide"
uggagauaggaacuacaacgccu

SEQ ID NO: 2205 - RNA, 21 nt, Artificial Sequence
  source: /note="Description of Artificial Sequence: Synthetic oligonucleotide"
uauauuuuacaacauccguua

SEQ ID NO: 2206 - RNA, 23 nt, Artificial Sequence
  source: /note="Description of Artificial Sequence: Synthetic oligonucleotide"
uaacggauguuguaaaauauauc

SEQ ID NO: 2207 - RNA, 21 nt, Artificial Sequence
  source: /note="Description of Artificial Sequence: Synthetic oligonucleotide"
augucgaguacacuuuuacua

SEQ ID NO: 2208 - RNA, 23 nt, Artificial Sequence
  source: /note="Description of Artificial Sequence: Synthetic oligonucleotide"
uaguaaaaguguacucgacauuu

SEQ ID NO: 2209 - RNA, 21 nt, Artificial Sequence
  source: /note="Description of Artificial Sequence: Synthetic oligonucleotide"
ugauaguuaccuaguuugcaa

SEQ ID NO: 2210 - RNA, 23 nt, Artificial Sequence
  source: /note="Description of Artificial Sequence: Synthetic oligonucleotide"
uugcaaacuagguaacuaucaaa

SEQ ID NO: 2211 - RNA, 21 nt, Artificial Sequence
  source: /note="Description of Artificial Sequence: Synthetic oligonucleotide"
gacuuaccuuuagaguauuga

SEQ ID NO: 2212 - RNA, 23 nt, Artificial Sequence
  source: /note="Description of Artificial Sequence: Synthetic oligonucleotide"
ucaauacucuaaagguaagucuu

SEQ ID NO: 2213 - RNA, 21 nt, Artificial Sequence
  source: /note="Description of Artificial Sequence: Synthetic oligonucleotide"
cuaaauuauggaaguaaucua

SEQ ID NO: 2214 - RNA, 23 nt, Artificial Sequence
  source: /note="Description of Artificial Sequence: Synthetic oligonucleotide"
uagauuacuuccauaauuuagga

SEQ ID NO: 2215 - RNA, 21 nt, Artificial Sequence
  source: /note="Description of Artificial Sequence: Synthetic oligonucleotide"
agucaaguuccaaaucguuca

SEQ ID NO: 2216 - RNA, 23 nt, Artificial Sequence
  source: /note="Description of Artificial Sequence: Synthetic oligonucleotide"
ugaacgauuuggaacuugacuug

SEQ ID NO: 2217 - RNA, 21 nt, Artificial Sequence
  source: /note="Description of Artificial Sequence: Synthetic oligonucleotide"
ugaucuucuuugucguaguga

SEQ ID NO: 2218 - RNA, 23 nt, Artificial Sequence
  source: /note="Description of Artificial Sequence: Synthetic oligonucleotide"
ucacuacgacaaagaagaucaug

SEQ ID NO: 2219 - RNA, 21 nt, Artificial Sequence
  source: /note="Description of Artificial Sequence: Synthetic oligonucleotide"
guuugaacacaaaucuuucga

SEQ ID NO: 2220 - RNA, 23 nt, Artificial Sequence
  source: /note="Description of Artificial Sequence: Synthetic oligonucleotide"
ucgaaagauuuguguucaaaccu

SEQ ID NO: 2221 - RNA, 21 nt, Artificial Sequence
  source: /note="Description of Artificial Sequence: Synthetic oligonucleotide"
aaguuccaaaucguuccgaaa

SEQ ID NO: 2222 - RNA, 23 nt, Artificial Sequence
  source: /note="Description of Artificial Sequence: Synthetic oligonucleotide"
uuucggaacgauuuggaacuuga

SEQ ID NO: 2223 - RNA, 21 nt, Artificial Sequence
  source: /note="Description of Artificial Sequence: Synthetic oligonucleotide"
uguagaucuugcaauuaccaa

SEQ ID NO: 2224 - RNA, 23 nt, Artificial Sequence
  source: /note="Description of Artificial Sequence: Synthetic oligonucleotide"
uugguaauugcaagaucuacaaa

SEQ ID NO: 2225 - RNA, 21 nt, Artificial Sequence
  source: /note="Description of Artificial Sequence: Synthetic oligonucleotide"
caugaucuucuuugucguaga

SEQ ID NO: 2226 - RNA, 23 nt, Artificial Sequence
  source: /note="Description of Artificial Sequence: Synthetic oligonucleotide"
ucuacgacaaagaagaucaugua

SEQ ID NO: 2227 - RNA, 21 nt, Artificial Sequence
  source: /note="Description of Artificial Sequence: Synthetic oligonucleotide"
uugauaguuaccuaguuugca

SEQ ID NO: 2228 - RNA, 23 nt, Artificial Sequence
  source: /note="Description of Artificial Sequence: Synthetic oligonucleotide"
ugcaaacuagguaacuaucaaaa

SEQ ID NO: 2229 - RNA, 21 nt, Artificial Sequence
  source: /note="Description of Artificial Sequence: Synthetic oligonucleotide"
caccuucuccuuaaaauucua

SEQ ID NO: 2230 - RNA, 23 nt, Artificial Sequence
  source: /note="Description of Artificial Sequence: Synthetic oligonucleotide"
uagaauuuuaaggagaaggugac

SEQ ID NO: 2231 - RNA, 21 nt, Artificial Sequence
  source: /note="Description of Artificial Sequence: Synthetic oligonucleotide"
cugauuuccuaagaaagguga

SEQ ID NO: 2232 - RNA, 23 nt, Artificial Sequence
  source: /note="Description of Artificial Sequence: Synthetic oligonucleotide"
ucaccuuucuuaggaaaucagag

SEQ ID NO: 2233 - RNA, 21 nt, Artificial Sequence
  source: /note="Description of Artificial Sequence: Synthetic oligonucleotide"
ugagacugacacauuguaaua

SEQ ID NO: 2234 - RNA, 23 nt, Artificial Sequence
  source: /note="Description of Artificial Sequence: Synthetic oligonucleotide"
uauuacaaugugucagucucaag

SEQ ID NO: 2235 - RNA, 21 nt, Artificial Sequence
  source: /note="Description of Artificial Sequence: Synthetic oligonucleotide"
cugaauauacaaguauuagga

SEQ ID NO: 2236 - RNA, 23 nt, Artificial Sequence
  source: /note="Description of Artificial Sequence: Synthetic oligonucleotide"
uccuaauacuuguauauucagcc

SEQ ID NO: 2237 - RNA, 21 nt, Artificial Sequence
  source: /note="Description of Artificial Sequence: Synthetic oligonucleotide"
caacccaaaauacuuagcaua

SEQ ID NO: 2238 - RNA, 23 nt, Artificial Sequence
  source: /note="Description of Artificial Sequence: Synthetic oligonucleotide"
uaugcuaaguauuuuggguugug

SEQ ID NO: 2239 - RNA, 21 nt, Artificial Sequence
  source: /note="Description of Artificial Sequence: Synthetic oligonucleotide"
cugauaauagucucuuaaaca

SEQ ID NO: 2240 - RNA, 23 nt, Artificial Sequence
  source: /note="Description of Artificial Sequence: Synthetic oligonucleotide"
uguuuaagagacuauuaucagua

SEQ ID NO: 2241 - RNA, 21 nt, Artificial Sequence
  source: /note="Description of Artificial Sequence: Synthetic oligonucleotide"
uuugucguagugauuuuccua

SEQ ID NO: 2242 - RNA, 23 nt, Artificial Sequence
  source: /note="Description of Artificial Sequence: Synthetic oligonucleotide"
uaggaaaaucacuacgacaaaga

SEQ ID NO: 2243 - RNA, 21 nt, Artificial Sequence
  source: /note="Description of Artificial Sequence: Synthetic oligonucleotide"
ugaauauacaaguauuaggaa

SEQ ID NO: 2244 - RNA, 23 nt, Artificial Sequence
  source: /note="Description of Artificial Sequence: Synthetic oligonucleotide"
uuccuaauacuuguauauucagc

SEQ ID NO: 2245 - RNA, 21 nt, Artificial Sequence
  source: /note="Description of Artificial Sequence: Synthetic oligonucleotide"
agauggauucucuucguucaa

SEQ ID NO: 2246 - RNA, 23 nt, Artificial Sequence
  source: /note="Description of Artificial Sequence: Synthetic oligonucleotide"
uugaacgaagagaauccaucucc

SEQ ID NO: 2247 - RNA, 21 nt, Artificial Sequence
  source: /note="Description of Artificial Sequence: Synthetic oligonucleotide"
aauaucauaaagcuguuuaca

SEQ ID NO: 2248 - RNA, 23 nt, Artificial Sequence
  source: /note="Description of Artificial Sequence: Synthetic oligonucleotide"
uguaaacagcuuuaugauauuca

SEQ ID NO: 2249 - RNA, 21 nt, Artificial Sequence
  source: /note="Description of Artificial Sequence: Synthetic oligonucleotide"
ucuuuauaccaucuuagguua

SEQ ID NO: 2250 - RNA, 23 nt, Artificial Sequence
  source: /note="Description of Artificial Sequence: Synthetic oligonucleotide"
uaaccuaagaugguauaaagaau

SEQ ID NO: 2251 - RNA, 21 nt, Artificial Sequence
  source: /note="Description of Artificial Sequence: Synthetic oligonucleotide"
gcaaaggucacaauuuccuca

SEQ ID NO: 2252 - RNA, 23 nt, Artificial Sequence
  source: /note="Description of Artificial Sequence: Synthetic oligonucleotide"
ugaggaaauugugaccuuugcuc

SEQ ID NO: 2253 - RNA, 21 nt, Artificial Sequence
  source: /note="Description of Artificial Sequence: Synthetic oligonucleotide"
agucaccacucagcauucgua

SEQ ID NO: 2254 - RNA, 23 nt, Artificial Sequence
  source: /note="Description of Artificial Sequence: Synthetic oligonucleotide"
uacgaaugcugaguggugacuga

SEQ ID NO: 2255 - RNA, 21 nt, Artificial Sequence
  source: /note="Description of Artificial Sequence: Synthetic oligonucleotide"
ugcuauaggaaauuuggucua

SEQ ID NO: 2256 - RNA, 23 nt, Artificial Sequence
  source: /note="Description of Artificial Sequence: Synthetic oligonucleotide"
uagaccaaauuuccuauagcaag

SEQ ID NO: 2257 - RNA, 21 nt, Artificial Sequence
  source: /note="Description of Artificial Sequence: Synthetic oligonucleotide"
gacagagaugaugauuuacua

SEQ ID NO: 2258 - RNA, 23 nt, Artificial Sequence
  source: /note="Description of Artificial Sequence: Synthetic oligonucleotide"
uaguaaaucaucaucucugucuc

SEQ ID NO: 2259 - RNA, 21 nt, Artificial Sequence
  source: /note="Description of Artificial Sequence: Synthetic oligonucleotide"
aagucaaguuccaaaucguua

SEQ ID NO: 2260 - RNA, 23 nt, Artificial Sequence
  source: /note="Description of Artificial Sequence: Synthetic oligonucleotide"
uaacgauuuggaacuugacuugc

SEQ ID NO: 2261 - RNA, 21 nt, Artificial Sequence
  source: /note="Description of Artificial Sequence: Synthetic oligonucleotide"
uaggcuaaugacccaagauua

SEQ ID NO: 2262 - RNA, 23 nt, Artificial Sequence
  source: /note="Description of Artificial Sequence: Synthetic oligonucleotide"
uaaucuugggucauuagccuaaa

SEQ ID NO: 2263 - RNA, 21 nt, Artificial Sequence
  source: /note="Description of Artificial Sequence: Synthetic oligonucleotide"
aagagcuuauuaaguauaaga

SEQ ID NO: 2264 - RNA, 23 nt, Artificial Sequence
  source: /note="Description of Artificial Sequence: Synthetic oligonucleotide"
ucuuauacuuaauaagcucuuuc

SEQ ID NO: 2265 - RNA, 21 nt, Artificial Sequence
  source: /note="Description of Artificial Sequence: Synthetic oligonucleotide"
uggaauauucuacuuuguuaa

SEQ ID NO: 2266 - RNA, 23 nt, Artificial Sequence
  source: /note="Description of Artificial Sequence: Synthetic oligonucleotide"
uuaacaaaguagaauauuccaac

SEQ ID NO: 2267 - RNA, 21 nt, Artificial Sequence
  source: /note="Description of Artificial Sequence: Synthetic oligonucleotide"
auguacagagguuauucuaua

SEQ ID NO: 2268 - RNA, 23 nt, Artificial Sequence
  source: /note="Description of Artificial Sequence: Synthetic oligonucleotide"
uauagaauaaccucuguacauug

SEQ ID NO: 2269 - RNA, 21 nt, Artificial Sequence
  source: /note="Description of Artificial Sequence: Synthetic oligonucleotide"
aucguaagagaacucuguaga

SEQ ID NO: 2270 - RNA, 23 nt, Artificial Sequence
  source: /note="Description of Artificial Sequence: Synthetic oligonucleotide"
ucuacagaguucucuuacgauuc

SEQ ID NO: 2271 - RNA, 21 nt, Artificial Sequence
  source: /note="Description of Artificial Sequence: Synthetic oligonucleotide"
caucuguuggaauauucuaca

SEQ ID NO: 2272 - RNA, 23 nt, Artificial Sequence
  source: /note="Description of Artificial Sequence: Synthetic oligonucleotide"
uguagaauauuccaacagauggg

SEQ ID NO: 2273 - RNA, 21 nt, Artificial Sequence
  source: /note="Description of Artificial Sequence: Synthetic oligonucleotide"
gucuuuacuggaaucuuugca

SEQ ID NO: 2274 - RNA, 23 nt, Artificial Sequence
  source: /note="Description of Artificial Sequence: Synthetic oligonucleotide"
ugcaaagauuccaguaaagacca

SEQ ID NO: 2275 - RNA, 21 nt, Artificial Sequence
  source: /note="Description of Artificial Sequence: Synthetic oligonucleotide"
caacacaauuucuucuuagca

SEQ ID NO: 2276 - RNA, 23 nt, Artificial Sequence
  source: /note="Description of Artificial Sequence: Synthetic oligonucleotide"
ugcuaagaagaaauuguguuguu

SEQ ID NO: 2277 - RNA, 21 nt, Artificial Sequence
  source: /note="Description of Artificial Sequence: Synthetic oligonucleotide"
uggauucucuucguucacaga

SEQ ID NO: 2278 - RNA, 23 nt, Artificial Sequence
  source: /note="Description of Artificial Sequence: Synthetic oligonucleotide"
ucugugaacgaagagaauccauc

SEQ ID NO: 2279 - RNA, 21 nt, Artificial Sequence
  source: /note="Description of Artificial Sequence: Synthetic oligonucleotide"
guauguuucuagcugauuuga

SEQ ID NO: 2280 - RNA, 23 nt, Artificial Sequence
  source: /note="Description of Artificial Sequence: Synthetic oligonucleotide"
ucaaaucagcuagaaacauaccu

SEQ ID NO: 2281 - RNA, 21 nt, Artificial Sequence
  source: /note="Description of Artificial Sequence: Synthetic oligonucleotide"
ccuuccugauaugcaguuaga

SEQ ID NO: 2282 - RNA, 23 nt, Artificial Sequence
  source: /note="Description of Artificial Sequence: Synthetic oligonucleotide"
ucuaacugcauaucaggaaggau

SEQ ID NO: 2283 - RNA, 21 nt, Artificial Sequence
  source: /note="Description of Artificial Sequence: Synthetic oligonucleotide"
ggagauggauucucuucguua

SEQ ID NO: 2284 - RNA, 23 nt, Artificial Sequence
  source: /note="Description of Artificial Sequence: Synthetic oligonucleotide"
uaacgaagagaauccaucucccc

SEQ ID NO: 2285 - RNA, 21 nt, Artificial Sequence
  source: /note="Description of Artificial Sequence: Synthetic oligonucleotide"
guagaaaacuuuuacaucuga

SEQ ID NO: 2286 - RNA, 23 nt, Artificial Sequence
  source: /note="Description of Artificial Sequence: Synthetic oligonucleotide"
ucagauguaaaaguuuucuacau

SEQ ID NO: 2287 - RNA, 21 nt, Artificial Sequence
  source: /note="Description of Artificial Sequence: Synthetic oligonucleotide"
agcgugcuuauagacguuaca

SEQ ID NO: 2288 - RNA, 23 nt, Artificial Sequence
  source: /note="Description of Artificial Sequence: Synthetic oligonucleotide"
uguaacgucuauaagcacgcuga

SEQ ID NO: 2289 - RNA, 21 nt, Artificial Sequence
  source: /note="Description of Artificial Sequence: Synthetic oligonucleotide"
guuucuagcugauuugauuga

SEQ ID NO: 2290 - RNA, 23 nt, Artificial Sequence
  source: /note="Description of Artificial Sequence: Synthetic oligonucleotide"
ucaaucaaaucagcuagaaacau

SEQ ID NO: 2291 - RNA, 21 nt, Artificial Sequence
  source: /note="Description of Artificial Sequence: Synthetic oligonucleotide"
gcccaaaauacugauaauaga

SEQ ID NO: 2292 - RNA, 23 nt, Artificial Sequence
  source: /note="Description of Artificial Sequence: Synthetic oligonucleotide"
ucuauuaucaguauuuugggcag

SEQ ID NO: 2293 - RNA, 21 nt, Artificial Sequence
  source: /note="Description of Artificial Sequence: Synthetic oligonucleotide"
uuuguccuaaucuacguauaa

SEQ ID NO: 2294 - RNA, 23 nt, Artificial Sequence
  source: /note="Description of Artificial Sequence: Synthetic oligonucleotide"
uuauacguagauuaggacaaaug

SEQ ID NO: 2295 - RNA, 21 nt, Artificial Sequence
  source: /note="Description of Artificial Sequence: Synthetic oligonucleotide"
uaaucgcugaacuuauuacaa

SEQ ID NO: 2296 - RNA, 23 nt, Artificial Sequence
  source: /note="Description of Artificial Sequence: Synthetic oligonucleotide"
uuguaauaaguucagcgauuaua

SEQ ID NO: 2297 - RNA, 21 nt, Artificial Sequence
  source: /note="Description of Artificial Sequence: Synthetic oligonucleotide"
uuugaauucaaucuaccguua

SEQ ID NO: 2298 - RNA, 23 nt, Artificial Sequence
  source: /note="Description of Artificial Sequence: Synthetic oligonucleotide"
uaacgguagauugaauucaaauu

SEQ ID NO: 2299 - RNA, 21 nt, Artificial Sequence
  source: /note="Description of Artificial Sequence: Synthetic oligonucleotide"
cucuuuugaggaagucuauga

SEQ ID NO: 2300 - RNA, 23 nt, Artificial Sequence
  source: /note="Description of Artificial Sequence: Synthetic oligonucleotide"
ucauagacuuccucaaaagaguu

SEQ ID NO: 2301 - RNA, 21 nt, Artificial Sequence
  source: /note="Description of Artificial Sequence: Synthetic oligonucleotide"
agcugauuugauugaaacgua

SEQ ID NO: 2302 - RNA, 23 nt, Artificial Sequence
  source: /note="Description of Artificial Sequence: Synthetic oligonucleotide"
uacguuucaaucaaaucagcuag

SEQ ID NO: 2303 - RNA, 21 nt, Artificial Sequence
  source: /note="Description of Artificial Sequence: Synthetic oligonucleotide"
cuuuauaccaucuuagguuca

SEQ ID NO: 2304 - RNA, 23 nt, Artificial Sequence
  source: /note="Description of Artificial Sequence: Synthetic oligonucleotide"
ugaaccuaagaugguauaaagaa

SEQ ID NO: 2305 - RNA, 21 nt, Artificial Sequence
  source: /note="Description of Artificial Sequence: Synthetic oligonucleotide"
uugcaagccucuuaugugaga

SEQ ID NO: 2306 - RNA, 23 nt, Artificial Sequence
  source: /note="Description of Artificial Sequence: Synthetic oligonucleotide"
ucucacauaagaggcuugcaacc

SEQ ID NO: 2307 - RNA, 21 nt, Artificial Sequence
  source: /note="Description of Artificial Sequence: Synthetic oligonucleotide"
uuauugcaucacuuguauaca

SEQ ID NO: 2308 - RNA, 23 nt, Artificial Sequence
  source: /note="Description of Artificial Sequence: Synthetic oligonucleotide"
uguauacaagugaugcaauaaau

SEQ ID NO: 2309 - RNA, 21 nt, Artificial Sequence
  source: /note="Description of Artificial Sequence: Synthetic oligonucleotide"
uuucacaggauuguaauuaga

SEQ ID NO: 2310 - RNA, 23 nt, Artificial Sequence
  source: /note="Description of Artificial Sequence: Synthetic oligonucleotide"
ucuaauuacaauccugugaaaag

SEQ ID NO: 2311 - RNA, 21 nt, Artificial Sequence
  source: /note="Description of Artificial Sequence: Synthetic oligonucleotide"
cuuuucacaggauuguaauua

SEQ ID NO: 2312 - RNA, 23 nt, Artificial Sequence
  source: /note="Description of Artificial Sequence: Synthetic oligonucleotide"
uaauuacaauccugugaaaagau

SEQ ID NO: 2313 - RNA, 21 nt, Artificial Sequence
  source: /note="Description of Artificial Sequence: Synthetic oligonucleotide"
cuguaggaauuauugauuaua

SEQ ID NO: 2314 - RNA, 23 nt, Artificial Sequence
  source: /note="Description of Artificial Sequence: Synthetic oligonucleotide"
uauaaucaauaauuccuacagag

SEQ ID NO: 2315 - RNA, 21 nt, Artificial Sequence
  source: /note="Description of Artificial Sequence: Synthetic oligonucleotide"
uuccugauaugcaguuaguua

SEQ ID NO: 2316 - RNA, 23 nt, Artificial Sequence
  source: /note="Description of Artificial Sequence: Synthetic oligonucleotide"
uaacuaacugcauaucaggaagg

SEQ ID NO: 2317 - RNA, 21 nt, Artificial Sequence
  source: /note="Description of Artificial Sequence: Synthetic oligonucleotide"
gcaagucaaguuccaaaucga

SEQ ID NO: 2318 - RNA, 23 nt, Artificial Sequence
  source: /note="Description of Artificial Sequence: Synthetic oligonucleotide"
ucgauuuggaacuugacuugcag

SEQ ID NO: 2319 - RNA, 21 nt, Artificial Sequence
  source: /note="Description of Artificial Sequence: Synthetic oligonucleotide"
ggaagaaagguucaugucuga

SEQ ID NO: 2320 - RNA, 23 nt, Artificial Sequence
  source: /note="Description of Artificial Sequence: Synthetic oligonucleotide"
ucagacaugaaccuuucuuccau

SEQ ID NO: 2321 - RNA, 21 nt, Artificial Sequence
  source: /note="Description of Artificial Sequence: Synthetic oligonucleotide"
aucuagggcuaaagauucuua

SEQ ID NO: 2322 - RNA, 23 nt, Artificial Sequence
  source: /note="Description of Artificial Sequence: Synthetic oligonucleotide"
uaagaaucuuuagcccuagauug

SEQ ID NO: 2323 - RNA, 21 nt, Artificial Sequence
  source: /note="Description of Artificial Sequence: Synthetic oligonucleotide"
uagcugauuugauugaaacga

SEQ ID NO: 2324 - RNA, 23 nt, Artificial Sequence
  source: /note="Description of Artificial Sequence: Synthetic oligonucleotide"
ucguuucaaucaaaucagcuaga

SEQ ID NO: 2325 - RNA, 21 nt, Artificial Sequence
  source: /note="Description of Artificial Sequence: Synthetic oligonucleotide"
cuuccugauaugcaguuagua

SEQ ID NO: 2326 - RNA, 23 nt, Artificial Sequence
  source: /note="Description of Artificial Sequence: Synthetic oligonucleotide"
uacuaacugcauaucaggaagga

SEQ ID NO: 2327 - RNA, 21 nt, Artificial Sequence
  source: /note="Description of Artificial Sequence: Synthetic oligonucleotide"
acugaugauucuuuaagaaua

SEQ ID NO: 2328 - RNA, 23 nt, Artificial Sequence
  source: /note="Description of Artificial Sequence: Synthetic oligonucleotide"
uauucuuaaagaaucaucagugc

SEQ ID NO: 2329 - RNA, 21 nt, Artificial Sequence
  source: /note="Description of Artificial Sequence: Synthetic oligonucleotide"
agacguuaccgcuuaaggcaa

SEQ ID NO: 2330 - RNA, 23 nt, Artificial Sequence
  source: /note="Description of Artificial Sequence: Synthetic oligonucleotide"
uugccuuaagcgguaacgucuau

SEQ ID NO: 2331 - RNA, 21 nt, Artificial Sequence
  source: /note="Description of Artificial Sequence: Synthetic oligonucleotide"
ucguggcuccuuguuuucuga

SEQ ID NO: 2332 - RNA, 23 nt, Artificial Sequence
  source: /note="Description of Artificial Sequence: Synthetic oligonucleotide"
ucagaaaacaaggagccacgaau

SEQ ID NO: 2333 - RNA, 21 nt, Artificial Sequence
  source: /note="Description of Artificial Sequence: Synthetic oligonucleotide"
ccuuucuucuuucauauccca

SEQ ID NO: 2334 - RNA, 23 nt, Artificial Sequence
  source: /note="Description of Artificial Sequence: Synthetic oligonucleotide"
ugggauaugaaagaagaaaggcu

SEQ ID NO: 2335 - RNA, 21 nt, Artificial Sequence
  source: /note="Description of Artificial Sequence: Synthetic oligonucleotide"
caucuuuucacaggauuguaa

SEQ ID NO: 2336 - RNA, 23 nt, Artificial Sequence
  source: /note="Description of Artificial Sequence: Synthetic oligonucleotide"
uuacaauccugugaaaagaugac

SEQ ID NO: 2337 - RNA, 21 nt, Artificial Sequence
  source: /note="Description of Artificial Sequence: Synthetic oligonucleotide"
cuguuggaaauagguuuugaa

SEQ ID NO: 2338 - RNA, 23 nt, Artificial Sequence
  source: /note="Description of Artificial Sequence: Synthetic oligonucleotide"
uucaaaaccuauuuccaacaggc

SEQ ID NO: 2339 - RNA, 21 nt, Artificial Sequence
  source: /note="Description of Artificial Sequence: Synthetic oligonucleotide"
gggagauggauucucuucgua

SEQ ID NO: 2340 - RNA, 23 nt, Artificial Sequence
  source: /note="Description of Artificial Sequence: Synthetic oligonucleotide"
uacgaagagaauccaucucccca

SEQ ID NO: 2341 - RNA, 21 nt, Artificial Sequence
  source: /note="Description of Artificial Sequence: Synthetic oligonucleotide"
uugaauucaaucuaccguuaa

SEQ ID NO: 2342 - RNA, 23 nt, Artificial Sequence
  source: /note="Description of Artificial Sequence: Synthetic oligonucleotide"
uuaacgguagauugaauucaaau

SEQ ID NO: 2343 - RNA, 21 nt, Artificial Sequence
  source: /note="Description of Artificial Sequence: Synthetic oligonucleotide"
ucaucuuaggcuauuugaaca

SEQ ID NO: 2344 - RNA, 23 nt, Artificial Sequence
  source: /note="Description of Artificial Sequence: Synthetic oligonucleotide"
uguucaaauagccuaagaugaau

SEQ ID NO: 2345 - RNA, 21 nt, Artificial Sequence
  source: /note="Description of Artificial Sequence: Synthetic oligonucleotide"
ugauucuuuaagaaucguaaa

SEQ ID NO: 2346 - RNA, 23 nt, Artificial Sequence
  source: /note="Description of Artificial Sequence: Synthetic oligonucleotide"
uuuacgauucuuaaagaaucauc

SEQ ID NO: 2347 - RNA, 21 nt, Artificial Sequence
  source: /note="Description of Artificial Sequence: Synthetic oligonucleotide"
guaauggacauuaguuaugaa

SEQ ID NO: 2348 - RNA, 23 nt, Artificial Sequence
  source: /note="Description of Artificial Sequence: Synthetic oligonucleotide"
uucauaacuaauguccauuacuu

SEQ ID NO: 2349 - RNA, 21 nt, Artificial Sequence
  source: /note="Description of Artificial Sequence: Synthetic oligonucleotide"
uugagacugacacauuguaaa

SEQ ID NO: 2350 - RNA, 23 nt, Artificial Sequence
  source: /note="Description of Artificial Sequence: Synthetic oligonucleotide"
uuuacaaugugucagucucaagu

SEQ ID NO: 2351 - RNA, 21 nt, Artificial Sequence
  source: /note="Description of Artificial Sequence: Synthetic oligonucleotide"
gaauucaaucuaccguuauua

SEQ ID NO: 2352 - RNA, 23 nt, Artificial Sequence
  source: /note="Description of Artificial Sequence: Synthetic oligonucleotide"
uaauaacgguagauugaauucaa

SEQ ID NO: 2353 - RNA, 21 nt, Artificial Sequence
  source: /note="Description of Artificial Sequence: Synthetic oligonucleotide"
augauucuuuaagaaucguaa

SEQ ID NO: 2354 - RNA, 23 nt, Artificial Sequence
  source: /note="Description of Artificial Sequence: Synthetic oligonucleotide"
uuacgauucuuaaagaaucauca

SEQ ID NO: 2355 - RNA, 21 nt, Artificial Sequence
  source: /note="Description of Artificial Sequence: Synthetic oligonucleotide"
agccuguuggaaauagguuua

SEQ ID NO: 2356 - RNA, 23 nt, Artificial Sequence
  source: /note="Description of Artificial Sequence: Synthetic oligonucleotide"
uaaaccuauuuccaacaggcuug

SEQ ID NO: 2357 - RNA, 21 nt, Artificial Sequence
  source: /note="Description of Artificial Sequence: Synthetic oligonucleotide"
cgugcuuauagacguuaccga

SEQ ID NO: 2358 - RNA, 23 nt, Artificial Sequence
  source: /note="Description of Artificial Sequence: Synthetic oligonucleotide"
ucgguaacgucuauaagcacgcu

SEQ ID NO: 2359 - RNA, 21 nt, Artificial Sequence
  source: /note="Description of Artificial Sequence: Synthetic oligonucleotide"
uuuaguggcaaacacucuuga

SEQ ID NO: 2360 - RNA, 23 nt, Artificial Sequence
  source: /note="Description of Artificial Sequence: Synthetic oligonucleotide"
ucaagaguguuugccacuaaagu

SEQ ID NO: 2361 - RNA, 21 nt, Artificial Sequence
  source: /note="Description of Artificial Sequence: Synthetic oligonucleotide"
accucucuuuccauguagaua

SEQ ID NO: 2362 - RNA, 23 nt, Artificial Sequence
  source: /note="Description of Artificial Sequence: Synthetic oligonucleotide"
uaucuacauggaaagagaggucu

SEQ ID NO: 2363 - RNA, 21 nt, Artificial Sequence
  source: /note="Description of Artificial Sequence: Synthetic oligonucleotide"
caacuuacuuuccuaaauuaa

SEQ ID NO: 2364 - RNA, 23 nt, Artificial Sequence
  source: /note="Description of Artificial Sequence: Synthetic oligonucleotide"
uuaauuuaggaaaguaaguuggu

SEQ ID NO: 2365 - RNA, 21 nt, Artificial Sequence
  source: /note="Description of Artificial Sequence: Synthetic oligonucleotide"
gcugaaccuaugaauuccgaa

SEQ ID NO: 2366 - RNA, 23 nt, Artificial Sequence
  source: /note="Description of Artificial Sequence: Synthetic oligonucleotide"
uucggaauucauagguucagccu

SEQ ID NO: 2367 - RNA, 21 nt, Artificial Sequence
  source: /note="Description of Artificial Sequence: Synthetic oligonucleotide"
uaucaaaauauucucgaagga

SEQ ID NO: 2368 - RNA, 23 nt, Artificial Sequence
  source: /note="Description of Artificial Sequence: Synthetic oligonucleotide"
uccuucgagaauauuuugauaaa

SEQ ID NO: 2369 - RNA, 21 nt, Artificial Sequence
  source: /note="Description of Artificial Sequence: Synthetic oligonucleotide"
acauccguuauuacuuugaga

SEQ ID NO: 2370 - RNA, 23 nt, Artificial Sequence
  source: /note="Description of Artificial Sequence: Synthetic oligonucleotide"
ucucaaaguaauaacggauguug

SEQ ID NO: 2371 - RNA, 21 nt, Artificial Sequence
  source: /note="Description of Artificial Sequence: Synthetic oligonucleotide"
agacauuuguccuaaucuaca

SEQ ID NO: 2372 - RNA, 23 nt, Artificial Sequence
  source: /note="Description of Artificial Sequence: Synthetic oligonucleotide"
uguagauuaggacaaaugucuca

SEQ ID NO: 2373 - RNA, 21 nt, Artificial Sequence
  source: /note="Description of Artificial Sequence: Synthetic oligonucleotide"
ugccacugaagaaaguacuga

SEQ ID NO: 2374 - RNA, 23 nt, Artificial Sequence
  source: /note="Description of Artificial Sequence: Synthetic oligonucleotide"
ucaguacuuucuucaguggcaac

SEQ ID NO: 2375 - RNA, 21 nt, Artificial Sequence
  source: /note="Description of Artificial Sequence: Synthetic oligonucleotide"
ucaucuuuucacaggauugua

SEQ ID NO: 2376 - RNA, 23 nt, Artificial Sequence
  source: /note="Description of Artificial Sequence: Synthetic oligonucleotide"
uacaauccugugaaaagaugaca

SEQ ID NO: 2377 - RNA, 21 nt, Artificial Sequence
  source: /note="Description of Artificial Sequence: Synthetic oligonucleotide"
cggacuugguuaccuaucuca

SEQ ID NO: 2378 - RNA, 23 nt, Artificial Sequence
  source: /note="Description of Artificial Sequence: Synthetic oligonucleotide"
ugagauagguaaccaaguccgac

SEQ ID NO: 2379 - RNA, 21 nt, Artificial Sequence
  source: /note="Description of Artificial Sequence: Synthetic oligonucleotide"
cucuuuccauguagauuacua

SEQ ID NO: 2380 - RNA, 23 nt, Artificial Sequence
  source: /note="Description of Artificial Sequence: Synthetic oligonucleotide"
uaguaaucuacauggaaagagag

SEQ ID NO: 2381 - RNA, 21 nt, Artificial Sequence
  source: /note="Description of Artificial Sequence: Synthetic oligonucleotide"
acaacuuucacuaauuugcua

SEQ ID NO: 2382 - RNA, 23 nt, Artificial Sequence
  source: /note="Description of Artificial Sequence: Synthetic oligonucleotide"
uagcaaauuagugaaaguuguuu

SEQ ID NO: 2383 - RNA, 21 nt, Artificial Sequence
  source: /note="Description of Artificial Sequence: Synthetic oligonucleotide"
uacaacauccguuauuacuua

SEQ ID NO: 2384 - RNA, 23 nt, Artificial Sequence
  source: /note="Description of Artificial Sequence: Synthetic oligonucleotide"
uaaguaauaacggauguuguaaa

SEQ ID NO: 2385 - RNA, 21 nt, Artificial Sequence
  source: /note="Description of Artificial Sequence: Synthetic oligonucleotide"
aaugucggacuugguuaccua

SEQ ID NO: 2386 - RNA, 23 nt, Artificial Sequence
  source: /note="Description of Artificial Sequence: Synthetic oligonucleotide"
uagguaaccaaguccgacauuau

SEQ ID NO: 2387 - RNA, 21 nt, Artificial Sequence
  source: /note="Description of Artificial Sequence: Synthetic oligonucleotide"
acaacauccguuauuacuuua

SEQ ID NO: 2388 - RNA, 23 nt, Artificial Sequence
  source: /note="Description of Artificial Sequence: Synthetic oligonucleotide"
uaaaguaauaacggauguuguaa

SEQ ID NO: 2389 - RNA, 21 nt, Artificial Sequence
  source: /note="Description of Artificial Sequence: Synthetic oligonucleotide"
cuucuuagccuuguuuaggca

SEQ ID NO: 2390 - RNA, 23 nt, Artificial Sequence
  source: /note="Description of Artificial Sequence: Synthetic oligonucleotide"
ugccuaaacaaggcuaagaaggc

SEQ ID NO: 2391 - RNA, 21 nt, Artificial Sequence
  source: /note="Description of Artificial Sequence: Synthetic oligonucleotide"
acacagguagaauguaguuua

SEQ ID NO: 2392 - RNA, 23 nt, Artificial Sequence
  source: /note="Description of Artificial Sequence: Synthetic oligonucleotide"
uaaacuacauucuaccuguguag

SEQ ID NO: 2393 - RNA, 21 nt, Artificial Sequence
  source: /note="Description of Artificial Sequence: Synthetic oligonucleotide"
cugaaccuaugaauuccgaua

SEQ ID NO: 2394 - RNA, 23 nt, Artificial Sequence
  source: /note="Description of Artificial Sequence: Synthetic oligonucleotide"
uaucggaauucauagguucagcc

SEQ ID NO: 2395 - RNA, 21 nt, Artificial Sequence
  source: /note="Description of Artificial Sequence: Synthetic oligonucleotide"
auucuuuaagaaucguaagaa

SEQ ID NO: 2396 - RNA, 23 nt, Artificial Sequence
  source: /note="Description of Artificial Sequence: Synthetic oligonucleotide"
uucuuacgauucuuaaagaauca

SEQ ID NO: 2397 - RNA, 21 nt, Artificial Sequence
  source: /note="Description of Artificial Sequence: Synthetic oligonucleotide"
gauucuuuaagaaucguaaga

SEQ ID NO: 2398 - RNA, 23 nt, Artificial Sequence
  source: /note="Description of Artificial Sequence: Synthetic oligonucleotide"
ucuuacgauucuuaaagaaucau

SEQ ID NO: 2399 - RNA, 21 nt, Artificial Sequence
  source: /note="Description of Artificial Sequence: Synthetic oligonucleotide"
guuucaggaaugucuacuuga

SEQ ID NO: 2400 - RNA, 23 nt, Artificial Sequence
  source: /note="Description of Artificial Sequence: Synthetic oligonucleotide"
ucaaguagacauuccugaaacaa

SEQ ID NO: 2401 - RNA, 21 nt, Artificial Sequence
  source: /note="Description of Artificial Sequence: Synthetic oligonucleotide"
uauagaaacaaagauuuauga

SEQ ID NO: 2402 - RNA, 23 nt, Artificial Sequence
  source: /note="Description of Artificial Sequence: Synthetic oligonucleotide"
ucauaaaucuuuguuucuauagg

SEQ ID NO: 2403 - RNA, 21 nt, Artificial Sequence
  source: /note="Description of Artificial Sequence: Synthetic oligonucleotide"
uuacaacauccguuauuacua

SEQ ID NO: 2404 - RNA, 23 nt, Artificial Sequence
  source: /note="Description of Artificial Sequence: Synthetic oligonucleotide"
uaguaauaacggauguuguaaaa

SEQ ID NO: 2405 - RNA, 21 nt, Artificial Sequence
  source: /note="Description of Artificial Sequence: Synthetic oligonucleotide"
uuucaggaaugucuacuugua

SEQ ID NO: 2406 - RNA, 23 nt, Artificial Sequence
  source: /note="Description of Artificial Sequence: Synthetic oligonucleotide"
uacaaguagacauuccugaaaca

SEQ ID NO: 2407 - RNA, 21 nt, Artificial Sequence
  source: /note="Description of Artificial Sequence: Synthetic oligonucleotide"
gauaauagucucuuaaacuca

SEQ ID NO: 2408 - RNA, 23 nt, Artificial Sequence
  source: /note="Description of Artificial Sequence: Synthetic oligonucleotide"
ugaguuuaagagacuauuaucag

SEQ ID NO: 2409 - RNA, 21 nt, Artificial Sequence
  source: /note="Description of Artificial Sequence: Synthetic oligonucleotide"
agagguuauucuauauuuuga

SEQ ID NO: 2410 - RNA, 23 nt, Artificial Sequence
  source: /note="Description of Artificial Sequence: Synthetic oligonucleotide"
ucaaaauauagaauaaccucugu

SEQ ID NO: 2411 - RNA, 21 nt, Artificial Sequence
  source: /note="Description of Artificial Sequence: Synthetic oligonucleotide"
ucacaaccacacuaaaacgga

SEQ ID NO: 2412 - RNA, 23 nt, Artificial Sequence
  source: /note="Description of Artificial Sequence: Synthetic oligonucleotide"
uccguuuuagugugguugugaug

SEQ ID NO: 2413 - RNA, 21 nt, Artificial Sequence
  source: /note="Description of Artificial Sequence: Synthetic oligonucleotide"
acacaauuucuucuuagcaua

SEQ ID NO: 2414 - RNA, 23 nt, Artificial Sequence
  source: /note="Description of Artificial Sequence: Synthetic oligonucleotide"
uaugcuaagaagaaauuguguug

SEQ ID NO: 2415 - RNA, 21 nt, Artificial Sequence
  source: /note="Description of Artificial Sequence: Synthetic oligonucleotide"
ucauccuggaaguucaguuga

SEQ ID NO: 2416 - RNA, 23 nt, Artificial Sequence
  source: /note="Description of Artificial Sequence: Synthetic oligonucleotide"
ucaacugaacuuccaggaugaac

SEQ ID NO: 2417 - RNA, 21 nt, Artificial Sequence
  source: /note="Description of Artificial Sequence: Synthetic oligonucleotide"
uugcaucagaaccaauuuaua

SEQ ID NO: 2418 - RNA, 23 nt, Artificial Sequence
  source: /note="Description of Artificial Sequence: Synthetic oligonucleotide"
uauaaauugguucugaugcaaug

SEQ ID NO: 2419 - RNA, 21 nt, Artificial Sequence
  source: /note="Description of Artificial Sequence: Synthetic oligonucleotide"
uucaucuuaggcuauuugaaa

SEQ ID NO: 2420 - RNA, 23 nt, Artificial Sequence
  source: /note="Description of Artificial Sequence: Synthetic oligonucleotide"
uuucaaauagccuaagaugaaug

SEQ ID NO: 2421 - RNA, 21 nt, Artificial Sequence
  source: /note="Description of Artificial Sequence: Synthetic oligonucleotide"
gauucuuuauaccaucuuaga

SEQ ID NO: 2422 - RNA, 23 nt, Artificial Sequence
  source: /note="Description of Artificial Sequence: Synthetic oligonucleotide"
ucuaagaugguauaaagaaucuu

SEQ ID NO: 2423 - RNA, 21 nt, Artificial Sequence
  source: /note="Description of Artificial Sequence: Synthetic oligonucleotide"
auaaucgcugaacuuauuaca

SEQ ID NO: 2424 - RNA, 23 nt, Artificial Sequence
  source: /note="Description of Artificial Sequence: Synthetic oligonucleotide"
uguaauaaguucagcgauuauaa

SEQ ID NO: 2425 - RNA, 21 nt, Artificial Sequence
  source: /note="Description of Artificial Sequence: Synthetic oligonucleotide"
auuuguccuaaucuacguaua

SEQ ID NO: 2426 - RNA, 23 nt, Artificial Sequence
  source: /note="Description of Artificial Sequence: Synthetic oligonucleotide"
uauacguagauuaggacaaaugu

SEQ ID NO: 2427 - RNA, 21 nt, Artificial Sequence
  source: /note="Description of Artificial Sequence: Synthetic oligonucleotide"
uuuuacaucugccuugucaua

SEQ ID NO: 2428 - RNA, 23 nt, Artificial Sequence
  source: /note="Description of Artificial Sequence: Synthetic oligonucleotide"
uaugacaaggcagauguaaaagu

SEQ ID NO: 2429 - RNA, 21 nt, Artificial Sequence
  source: /note="Description of Artificial Sequence: Synthetic oligonucleotide"
acauuuguccuaaucuacgua

SEQ ID NO: 2430 - RNA, 23 nt, Artificial Sequence
  source: /note="Description of Artificial Sequence: Synthetic oligonucleotide"
uacguagauuaggacaaaugucu

SEQ ID NO: 2431 - RNA, 21 nt, Artificial Sequence
  source: /note="Description of Artificial Sequence: Synthetic oligonucleotide"
uguuuagucauccuuucgcua

SEQ ID NO: 2432 - RNA, 23 nt, Artificial Sequence
  source: /note="Description of Artificial Sequence: Synthetic oligonucleotide"
uagcgaaaggaugacuaaacaau

SEQ ID NO: 2433 - RNA, 21 nt, Artificial Sequence
  source: /note="Description of Artificial Sequence: Synthetic oligonucleotide"
ucuccuuaaaauucuaugaua

SEQ ID NO: 2434 - RNA, 23 nt, Artificial Sequence
  source: /note="Description of Artificial Sequence: Synthetic oligonucleotide"
uaucauagaauuuuaaggagaag

SEQ ID NO: 2435 - RNA, 21 nt, Artificial Sequence
  source: /note="Description of Artificial Sequence: Synthetic oligonucleotide"
acaggauuguaauuagucuua

SEQ ID NO: 2436 - RNA, 23 nt, Artificial Sequence
  source: /note="Description of Artificial Sequence: Synthetic oligonucleotide"
uaagacuaauuacaauccuguga

SEQ ID NO: 2437 - RNA, 21 nt, Artificial Sequence
  source: /note="Description of Artificial Sequence: Synthetic oligonucleotide"
uagguucauucaucuuaggca

SEQ ID NO: 2438 - RNA, 23 nt, Artificial Sequence
  source: /note="Description of Artificial Sequence: Synthetic oligonucleotide"
ugccuaagaugaaugaaccuaag

SEQ ID NO: 2439 - RNA, 21 nt, Artificial Sequence
  source: /note="Description of Artificial Sequence: Synthetic oligonucleotide"
aacaacuuucacuaauuugca

SEQ ID NO: 2440 - RNA, 23 nt, Artificial Sequence
  source: /note="Description of Artificial Sequence: Synthetic oligonucleotide"
ugcaaauuagugaaaguuguuuu

SEQ ID NO: 2441 - RNA, 21 nt, Artificial Sequence
  source: /note="Description of Artificial Sequence: Synthetic oligonucleotide"
aagccuuugauauuaguauca

SEQ ID NO: 2442 - RNA, 23 nt, Artificial Sequence
  source: /note="Description of Artificial Sequence: Synthetic oligonucleotide"
ugauacuaauaucaaaggcuuga

SEQ ID NO: 2443 - RNA, 21 nt, Artificial Sequence
  source: /note="Description of Artificial Sequence: Synthetic oligonucleotide"
cuuucuucuuucauaucccua

SEQ ID NO: 2444 - RNA, 23 nt, Artificial Sequence
  source: /note="Description of Artificial Sequence: Synthetic oligonucleotide"
uagggauaugaaagaagaaaggc

SEQ ID NO: 2445 - RNA, 21 nt, Artificial Sequence
  source: /note="Description of Artificial Sequence: Synthetic oligonucleotide"
ucacaggauuguaauuaguca

SEQ ID NO: 2446 - RNA, 23 nt, Artificial Sequence
  source: /note="Description of Artificial Sequence: Synthetic oligonucleotide"
ugacuaauuacaauccugugaaa

SEQ ID NO: 2447 - RNA, 21 nt, Artificial Sequence
  source: /note="Description of Artificial Sequence: Synthetic oligonucleotide"
uugcccuuaugaauguuagua

SEQ ID NO: 2448 - RNA, 23 nt, Artificial Sequence
  source: /note="Description of Artificial Sequence: Synthetic oligonucleotide"
uacuaacauucauaagggcaaaa

SEQ ID NO: 2449 - RNA, 21 nt, Artificial Sequence
  source: /note="Description of Artificial Sequence: Synthetic oligonucleotide"
caucagaaccaauuuauauga

SEQ ID NO: 2450 - RNA, 23 nt, Artificial Sequence
  source: /note="Description of Artificial Sequence: Synthetic oligonucleotide"
ucauauaaauugguucugaugca

SEQ ID NO: 2451 - RNA, 21 nt, Artificial Sequence
  source: /note="Description of Artificial Sequence: Synthetic oligonucleotide"
auucaaucuaccguuauuuca

SEQ ID NO: 2452 - RNA, 23 nt, Artificial Sequence
  source: /note="Description of Artificial Sequence: Synthetic oligonucleotide"
ugaaauaacgguagauugaauuc

SEQ ID NO: 2453 - RNA, 21 nt, Artificial Sequence
  source: /note="Description of Artificial Sequence: Synthetic oligonucleotide"
uuucgcuguaagcaaaguuga

SEQ ID NO: 2454 - RNA, 23 nt, Artificial Sequence
  source: /note="Description of Artificial Sequence: Synthetic oligonucleotide"
ucaacuuugcuuacagcgaaagg

SEQ ID NO: 2455 - RNA, 21 nt, Artificial Sequence
  source: /note="Description of Artificial Sequence: Synthetic oligonucleotide"
auuguuuagucauccuuucga

SEQ ID NO: 2456 - RNA, 23 nt, Artificial Sequence
  source: /note="Description of Artificial Sequence: Synthetic oligonucleotide"
ucgaaaggaugacuaaacaauac

SEQ ID NO: 2457 - RNA, 21 nt, Artificial Sequence
  source: /note="Description of Artificial Sequence: Synthetic oligonucleotide"
gagacauuuguccuaaucuaa

SEQ ID NO: 2458 - RNA, 23 nt, Artificial Sequence
  source: /note="Description of Artificial Sequence: Synthetic oligonucleotide"
uuagauuaggacaaaugucucaa

SEQ ID NO: 2459 - RNA, 21 nt, Artificial Sequence
  source: /note="Description of Artificial Sequence: Synthetic oligonucleotide"
uugccaacuugcucucuugca

SEQ ID NO: 2460 - RNA, 23 nt, Artificial Sequence
  source: /note="Description of Artificial Sequence: Synthetic oligonucleotide"
ugcaagagagcaaguuggcaaga

SEQ ID NO: 2461 - RNA, 21 nt, Artificial Sequence
  source: /note="Description of Artificial Sequence: Synthetic oligonucleotide"
auguauauuugaccuagugaa

SEQ ID NO: 2462 - RNA, 23 nt, Artificial Sequence
  source: /note="Description of Artificial Sequence: Synthetic oligonucleotide"
uucacuaggucaaauauacaucc

SEQ ID NO: 2463 - RNA, 21 nt, Artificial Sequence
  source: /note="Description of Artificial Sequence: Synthetic oligonucleotide"
cacaggauuguaauuagucua

SEQ ID NO: 2464 - RNA, 23 nt, Artificial Sequence
  source: /note="Description of Artificial Sequence: Synthetic oligonucleotide"
uagacuaauuacaauccugugaa

SEQ ID NO: 2465 - RNA, 21 nt, Artificial Sequence
  source: /note="Description of Artificial Sequence: Synthetic oligonucleotide"
gauguuugacagguucgugua

SEQ ID NO: 2466 - RNA, 23 nt, Artificial Sequence
  source: /note="Description of Artificial Sequence: Synthetic oligonucleotide"
uacacgaaccugucaaacaucuu

SEQ ID NO: 2467 - RNA, 21 nt, Artificial Sequence
  source: /note="Description of Artificial Sequence: Synthetic oligonucleotide"
uagcuguagacaucuaguuua

SEQ ID NO: 2468 - RNA, 23 nt, Artificial Sequence
  source: /note="Description of Artificial Sequence: Synthetic oligonucleotide"
uaaacuagaugucuacagcuaau

SEQ ID NO: 2469 - RNA, 21 nt, Artificial Sequence
  source: /note="Description of Artificial Sequence: Synthetic oligonucleotide"
uacacagguagaauguaguua

SEQ ID NO: 2470 - RNA, 23 nt, Artificial Sequence
  source: /note="Description of Artificial Sequence: Synthetic oligonucleotide"
uaacuacauucuaccuguguagc

SEQ ID NO: 2471 - RNA, 21 nt, Artificial Sequence
  source: /note="Description of Artificial Sequence: Synthetic oligonucleotide"
agucucuuaaacucuuuugua

SEQ ID NO: 2472 - RNA, 23 nt, Artificial Sequence
  source: /note="Description of Artificial Sequence: Synthetic oligonucleotide"
uacaaaagaguuuaagagacuau

SEQ ID NO: 2473 - RNA, 21 nt, Artificial Sequence
  source: /note="Description of Artificial Sequence: Synthetic oligonucleotide"
aucacaaccacacuaaaacga

SEQ ID NO: 2474 - RNA, 23 nt, Artificial Sequence
  source: /note="Description of Artificial Sequence: Synthetic oligonucleotide"
ucguuuuagugugguugugaugg

SEQ ID NO: 2475 - RNA, 21 nt, Artificial Sequence
  source: /note="Description of Artificial Sequence: Synthetic oligonucleotide"
cauuuguccuaaucuacguaa

SEQ ID NO: 2476 - RNA, 23 nt, Artificial Sequence
  source: /note="Description of Artificial Sequence: Synthetic oligonucleotide"
uuacguagauuaggacaaauguc

SEQ ID NO: 2477 - RNA, 21 nt, Artificial Sequence
  source: /note="Description of Artificial Sequence: Synthetic oligonucleotide"
cugccaaguuaacauagagua

SEQ ID NO: 2478 - RNA, 23 nt, Artificial Sequence
  source: /note="Description of Artificial Sequence: Synthetic oligonucleotide"
uacucuauguuaacuuggcagca

SEQ ID NO: 2479 - RNA, 21 nt, Artificial Sequence
  source: /note="Description of Artificial Sequence: Synthetic oligonucleotide"
auuagcuguagacaucuagua

SEQ ID NO: 2480 - RNA, 23 nt, Artificial Sequence
  source: /note="Description of Artificial Sequence: Synthetic oligonucleotide"
uacuagaugucuacagcuaaugc

SEQ ID NO: 2481 - RNA, 21 nt, Artificial Sequence
  source: /note="Description of Artificial Sequence: Synthetic oligonucleotide"
gucucuuaaacucuuuuguca

SEQ ID NO: 2482 - RNA, 23 nt, Artificial Sequence
  source: /note="Description of Artificial Sequence: Synthetic oligonucleotide"
ugacaaaagaguuuaagagacua

SEQ ID NO: 2483 - RNA, 21 nt, Artificial Sequence
  source: /note="Description of Artificial Sequence: Synthetic oligonucleotide"
gacauuuguccuaaucuacga

SEQ ID NO: 2484 - RNA, 23 nt, Artificial Sequence
  source: /note="Description of Artificial Sequence: Synthetic oligonucleotide"
ucguagauuaggacaaaugucuc

SEQ ID NO: 2485 - RNA, 21 nt, Artificial Sequence
  source: /note="Description of Artificial Sequence: Synthetic oligonucleotide"
uucuuuauaccaucuuaggua

SEQ ID NO: 2486 - RNA, 23 nt, Artificial Sequence
  source: /note="Description of Artificial Sequence: Synthetic oligonucleotide"
uaccuaagaugguauaaagaauc

SEQ ID NO: 2487 - RNA, 21 nt, Artificial Sequence
  source: /note="Description of Artificial Sequence: Synthetic oligonucleotide"
cacagguagaauguaguuuua

SEQ ID NO: 2488 - RNA, 23 nt, Artificial Sequence
  source: /note="Description of Artificial Sequence: Synthetic oligonucleotide"
uaaaacuacauucuaccugugua

SEQ ID NO: 2489 - RNA, 21 nt, Artificial Sequence
  source: /note="Description of Artificial Sequence: Synthetic oligonucleotide"
auguagauuacuguuuguaca

SEQ ID NO: 2490 - RNA, 23 nt, Artificial Sequence
  source: /note="Description of Artificial Sequence: Synthetic oligonucleotide"
uguacaaacaguaaucuacaugg

SEQ ID NO: 2491 - RNA, 21 nt, Artificial Sequence
  source: /note="Description of Artificial Sequence: Synthetic oligonucleotide"
ucacuuguauacaaucccgua

SEQ ID NO: 2492 - RNA, 23 nt, Artificial Sequence
  source: /note="Description of Artificial Sequence: Synthetic oligonucleotide"
uacgggauuguauacaagugaug

SEQ ID NO: 2493 - RNA, 21 nt, Artificial Sequence
  source: /note="Description of Artificial Sequence: Synthetic oligonucleotide"
auucaucuuaggcuauuugaa

SEQ ID NO: 2494 - RNA, 23 nt, Artificial Sequence
  source: /note="Description of Artificial Sequence: Synthetic oligonucleotide"
uucaaauagccuaagaugaauga

SEQ ID NO: 2495 - RNA, 21 nt, Artificial Sequence
  source: /note="Description of Artificial Sequence: Synthetic oligonucleotide"
cauucaucuuaggcuauuuga

SEQ ID NO: 2496 - RNA, 23 nt, Artificial Sequence
  source: /note="Description of Artificial Sequence: Synthetic oligonucleotide"
ucaaauagccuaagaugaaugaa

SEQ ID NO: 2497 - RNA, 21 nt, Artificial Sequence
  source: /note="Description of Artificial Sequence: Synthetic oligonucleotide"
agagcuuauuaaguauaagca

SEQ ID NO: 2498 - RNA, 23 nt, Artificial Sequence
  source: /note="Description of Artificial Sequence: Synthetic oligonucleotide"
ugcuuauacuuaauaagcucuuu

SEQ ID NO: 2499 - RNA, 21 nt, Artificial Sequence
  source: /note="Description of Artificial Sequence: Synthetic oligonucleotide"
ugaugauucuuuaagaaucga

SEQ ID NO: 2500 - RNA, 23 nt, Artificial Sequence
  source: /note="Description of Artificial Sequence: Synthetic oligonucleotide"
ucgauucuuaaagaaucaucagu

SEQ ID NO: 2501 - RNA, 21 nt, Artificial Sequence
  source: /note="Description of Artificial Sequence: Synthetic oligonucleotide"
caacagauguuagaccgucua

SEQ ID NO: 2502 - RNA, 23 nt, Artificial Sequence
  source: /note="Description of Artificial Sequence: Synthetic oligonucleotide"
uagacggucuaacaucuguugaa

SEQ ID NO: 2503 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uugugacutuaaguuuaguga

SEQ ID NO: 2504 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uauugugacutuaaguuuaga

SEQ ID NO: 2505 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uucuguguaggagaauucaca

SEQ ID NO: 2506 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
caugaucutctuugucguaga

SEQ ID NO: 2507 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uguaggagaatucacuuuuca

SEQ ID NO: 2508 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugucgaguacacuuuuacuga

SEQ ID NO: 2509 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
augaucuucutugucguagua

SEQ ID NO: 2510 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aucugagacugaauuugccga

SEQ ID NO: 2511 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugaucuuctutgucguaguga

SEQ ID NO: 2512 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aagggaaaacaaucuuccgua

SEQ ID NO: 2513 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agcuugaaguaaaauuagaca

SEQ ID NO: 2514 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugcuauaggaaauuuggucua

SEQ ID NO: 2515 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aucuucuutgtcguagugaua

SEQ ID NO: 2516 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gaucuucutugucguagugaa

SEQ ID NO: 2517 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuauugcatcacuuguauaca

SEQ ID NO: 2518 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
caacacaatutcuucuuagca

SEQ ID NO: 2519 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cuguuggaaatagguuuugaa

SEQ ID NO: 2520 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuuguagatctugcaauuaca

SEQ ID NO: 2521 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugguuucagcacagauucaga

SEQ ID NO: 2522 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uugauagutaccuaguuugca

SEQ ID NO: 2523 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acaugauctucuuugucguaa

SEQ ID NO: 2524 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
guuugaacacaaaucuuucga

SEQ ID NO: 2525 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugagacugacacauuguaaua

SEQ ID NO: 2526 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
augucgagtacacuuuuacua

SEQ ID NO: 2527 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugauaguuaccuaguuugcaa

SEQ ID NO: 2528 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uauauuuuacaacauccguua

SEQ ID NO: 2529 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cuuuauaccatcuuagguuca

SEQ ID NO: 2530 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auguacagagguuauucuaua

SEQ ID NO: 2531 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gcguuguagutccuaucucca

SEQ ID NO: 2532 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aagucaagtuccaaaucguua

SEQ ID NO: 2533 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gcaagucaagtuccaaaucga

SEQ ID NO: 2534 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuggcagaaacccugauuaua

SEQ ID NO: 2535 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cugauuuccuaagaaagguga

SEQ ID NO: 2536 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucguggcucctuguuuucuga

SEQ ID NO: 2537 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gucuuuactggaaucuuugca

SEQ ID NO: 2538 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cuucugaaacauccaaacuga

SEQ ID NO: 2539 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uugcuauaggaaauuugguca

SEQ ID NO: 2540 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agccuguuggaaauagguuua

SEQ ID NO: 2541 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auguuucuagcugauuugaua

SEQ ID NO: 2542 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uugcaagccucuuaugugaga

SEQ ID NO: 2543 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuuaguggcaaacacucuuga

SEQ ID NO: 2544 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gacuuacctutagaguauuga

SEQ ID NO: 2545 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ggcguuguagtuccuaucuca

SEQ ID NO: 2546 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuugucguagtgauuuuccua

SEQ ID NO: 2547 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
caacuuactutccuaaauuaa

SEQ ID NO: 2548 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
guauguuucuagcugauuuga

SEQ ID NO: 2549 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gacagagatgaugauuuacua

SEQ ID NO: 2550 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gagauggatucucuucguuca

SEQ ID NO: 2551 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuccugauaugcaguuaguua

SEQ ID NO: 2552 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
caccuucucctuaaaauucua

SEQ ID NO: 2553 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cugauaauagtcucuuaaaca

SEQ ID NO: 2554 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cuaaauuatggaaguaaucua

SEQ ID NO: 2555 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucuuuauaccaucuuagguua

SEQ ID NO: 2556 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ggagauggautcucuucguua

SEQ ID NO: 2557 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugaauauacaaguauuaggaa

SEQ ID NO: 2558 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
guuucuagcugauuugauuga

SEQ ID NO: 2559 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agucaagutccaaaucguuca

SEQ ID NO: 2560 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
caucuguuggaauauucuaca

SEQ ID NO: 2561 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cugaaccuaugaauuccgaua

SEQ ID NO: 2562 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cuuuucacaggauuguaauua

SEQ ID NO: 2563 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agcgugcutatagacguuaca

SEQ ID NO: 2564 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cuuccugatatgcaguuagua

SEQ ID NO: 2565 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ggaagaaaggtucaugucuga

SEQ ID NO: 2566 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
guagaaaacutuuacaucuga

SEQ ID NO: 2567 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucaucuuutcacaggauugua

SEQ ID NO: 2568 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gcccaaaatacugauaauaga

SEQ ID NO: 2569 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuuuacaucugccuugucaua

SEQ ID NO: 2570 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uaggcuaatgacccaagauua

SEQ ID NO: 2571 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cgugcuuatagacguuaccga

SEQ ID NO: 2572 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cuucuuagcctuguuuaggca

SEQ ID NO: 2573 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uggaauautctacuuuguuaa

SEQ ID NO: 2574 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cugaauauacaaguauuagga

SEQ ID NO: 2575 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cugccaagtuaacauagagua

SEQ ID NO: 2576 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uggauucucutcguucacaga

SEQ ID NO: 2577 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gcaaaggucacaauuuccuca

SEQ ID NO: 2578 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugccacugaagaaaguacuga

SEQ ID NO: 2579 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccuuccugauaugcaguuaga

SEQ ID NO: 2580 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
caucuuuucacaggauuguaa

SEQ ID NO: 2581 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gggagauggatucucuucgua

SEQ ID NO: 2582 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaugucggactugguuaccua

SEQ ID NO: 2583 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucauccuggaaguucaguuga

SEQ ID NO: 2584 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auguauautugaccuagugaa

SEQ ID NO: 2585 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agucaccacucagcauucgua

SEQ ID NO: 2586 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aucguaagagaacucuguaga

SEQ ID NO: 2587 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gcugaacctatgaauuccgaa

SEQ ID NO: 2588 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cggacuuggutaccuaucuca

SEQ ID NO: 2589 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agauggautctcuucguucaa

SEQ ID NO: 2590 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agacguuaccgcuuaaggcaa

SEQ ID NO: 2591 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uguagauctugcaauuaccaa

SEQ ID NO: 2592 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uugcccuuaugaauguuagua

SEQ ID NO: 2593 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucactaaacuuaaagtcacaaua

SEQ ID NO: 2594 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucuaaacuuaaagtcacaauaag

SEQ ID NO: 2595 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugugaatucuccuacacagaagc

SEQ ID NO: 2596 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucuacgacaaagaagaucaugua

SEQ ID NO: 2597 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugaaaagugaatucuccuacaca

SEQ ID NO: 2598 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucagtaaaaguguactcgacauu

SEQ ID NO: 2599 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uacuacgacaaagaagaucaugu

SEQ ID NO: 2600 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucggcaaauucagtctcagaucc

SEQ ID NO: 2601 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucactacgacaaagaagaucaug

SEQ ID NO: 2602 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uacggaagauugututcccuuug

SEQ ID NO: 2603 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uguctaauuuuactucaagcuua

SEQ ID NO: 2604 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uagaccaaauutccuauagcaag

SEQ ID NO: 2605 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uaucactacgacaaagaagauca

SEQ ID NO: 2606 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
utcacuacgacaaagaagaucau

SEQ ID NO: 2607 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uguatacaagugatgcaauaaau

SEQ ID NO: 2608 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugcuaagaagaaatuguguuguu

SEQ ID NO: 2609 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
utcaaaaccuatutccaacaggc

SEQ ID NO: 2610 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uguaautgcaagatctacaaaag

SEQ ID NO: 2611 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucugaatcugugctgaaaccaca

SEQ ID NO: 2612 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugcaaacuaggtaactaucaaaa

SEQ ID NO: 2613 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
utacgacaaagaagatcauguag

SEQ ID NO: 2614 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucgaaagauuugugutcaaaccu

SEQ ID NO: 2615 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uauuacaaugugucagucucaag

SEQ ID NO: 2616 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uaguaaaagugtacucgacauuu

SEQ ID NO: 2617 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
utgcaaacuagguaacuaucaaa

SEQ ID NO: 2618 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uaacggauguuguaaaauauauc

SEQ ID NO: 2619 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugaacctaagatgguauaaagaa

SEQ ID NO: 2620 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uauagaauaaccucuguacauug

SEQ ID NO: 2621 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uggagataggaactacaacgccu

SEQ ID NO: 2622 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uaacgatuuggaacutgacuugc

SEQ ID NO: 2623 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucgatutggaacutgacuugcag

SEQ ID NO: 2624 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uauaaucagggtutctgccaauu

SEQ ID NO: 2625 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucaccutucuuaggaaaucagag

SEQ ID NO: 2626 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucagaaaacaaggagccacgaau

SEQ ID NO: 2627 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugcaaagauuccaguaaagacca

SEQ ID NO: 2628 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucagtutggaugutucagaagaa

SEQ ID NO: 2629 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugaccaaauuucctatagcaagu

SEQ ID NO: 2630 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uaaacctauuuccaacaggcuug

SEQ ID NO: 2631 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uaucaaaucagcuagaaacauac

SEQ ID NO: 2632 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucucacauaagaggctugcaacc

SEQ ID NO: 2633 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucaagaguguutgccacuaaagu

SEQ ID NO: 2634 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucaatacucuaaaggtaagucuu

SEQ ID NO: 2635 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugagauaggaacuacaacgccuu

SEQ ID NO: 2636 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uaggaaaaucacuacgacaaaga

SEQ ID NO: 2637 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
utaatutaggaaaguaaguuggu

SEQ ID NO: 2638 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucaaaucagcuagaaacauaccu

SEQ ID NO: 2639 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uaguaaaucaucatctcugucuc

SEQ ID NO: 2640 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugaacgaagagaatccaucuccc

SEQ ID NO: 2641 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uaactaacugcauaucaggaagg

SEQ ID NO: 2642 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uagaautuuaaggagaaggugac

SEQ ID NO: 2643 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uguutaagagacuautaucagua

SEQ ID NO: 2644 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uagatuacuuccataauuuagga

SEQ ID NO: 2645 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uaaccuaagauggtataaagaau

SEQ ID NO: 2646 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uaacgaagagaauccaucucccc

SEQ ID NO: 2647 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
utcctaauacutgtatauucagc

SEQ ID NO: 2648 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucaatcaaaucagcuagaaacau

SEQ ID NO: 2649 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugaacgauuuggaactugacuug

SEQ ID NO: 2650 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uguagaauauuccaacagauggg

SEQ ID NO: 2651 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uaucggaauucauagguucagcc

SEQ ID NO: 2652 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uaautacaauccugugaaaagau

SEQ ID NO: 2653 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uguaacgucuataagcacgcuga

SEQ ID NO: 2654 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uacuaacugcatatcaggaagga

SEQ ID NO: 2655 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucagacaugaacctutcuuccau

SEQ ID NO: 2656 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucagauguaaaagtutucuacau

SEQ ID NO: 2657 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uacaauccugugaaaagaugaca

SEQ ID NO: 2658 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucuatuaucagtatutugggcag

SEQ ID NO: 2659 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uaugacaaggcagauguaaaagu

SEQ ID NO: 2660 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uaaucutgggucatuagccuaaa

SEQ ID NO: 2661 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucggtaacguctataagcacgcu

SEQ ID NO: 2662 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugcctaaacaaggcuaagaaggc

SEQ ID NO: 2663 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
utaacaaaguagaauauuccaac

SEQ ID NO: 2664 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uccuaatacuuguauauucagcc

SEQ ID NO: 2665 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uacucuauguuaacutggcagca

SEQ ID NO: 2666 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucugtgaacgaagagaauccauc

SEQ ID NO: 2667 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugaggaaauugtgaccuuugcuc

SEQ ID NO: 2668 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucagtacuuuctucaguggcaac

SEQ ID NO: 2669 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucuaactgcauaucaggaaggau

SEQ ID NO: 2670 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
utacaatccugtgaaaagaugac

SEQ ID NO: 2671 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uacgaagagaatccatcucccca

SEQ ID NO: 2672 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uaggtaaccaaguccgacauuau

SEQ ID NO: 2673 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucaacugaacutccaggaugaac

SEQ ID NO: 2674 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
utcacuaggucaaauauacaucc

SEQ ID NO: 2675 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uacgaatgcugagtggugacuga

SEQ ID NO: 2676 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucuacagaguucucutacgauuc

SEQ ID NO: 2677 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
utcggaauucataggtucagccu

SEQ ID NO: 2678 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugagauagguaaccaaguccgac

SEQ ID NO: 2679 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
utgaacgaagagaauccaucucc

SEQ ID NO: 2680 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
utgccutaagcggtaacgucuau

SEQ ID NO: 2681 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
utggtaauugcaagatcuacaaa

SEQ ID NO: 2682 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uacuaacauucauaagggcaaaa

SEQ ID NO: 2683 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uugugacutuaaguuuaguga

SEQ ID NO: 2684 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uauugugacutuaaguuuaga

SEQ ID NO: 2685 - RNA, 21 nt, Artificial Sequence
  source: /note="Description of Artificial Sequence: Synthetic oligonucleotide"
uucuguguaggagaauucaca

SEQ ID NO: 2686 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
caugaucutctuugucguaga

SEQ ID NO: 2687 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uguaggagaatucacuuuuca

SEQ ID NO: 2688 - RNA, 21 nt, Artificial Sequence
  source: /note="Description of Artificial Sequence: Synthetic oligonucleotide"
ugucgaguacacuuuuacuga

SEQ ID NO: 2689 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
augaucuucutugucguagua

SEQ ID NO: 2690 - RNA, 21 nt, Artificial Sequence
  source: /note="Description of Artificial Sequence: Synthetic oligonucleotide"
aucugagacugaauuugccga

SEQ ID NO: 2691 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugaucuuctutgucguaguga

SEQ ID NO: 2692 - RNA, 21 nt, Artificial Sequence
  source: /note="Description of Artificial Sequence: Synthetic oligonucleotide"
aagggaaaacaaucuuccgua

SEQ ID NO: 2693 - RNA, 21 nt, Artificial Sequence
  source: /note="Description of Artificial Sequence: Synthetic oligonucleotide"
agcuugaaguaaaauuagaca

SEQ ID NO: 2694 - RNA, 21 nt, Artificial Sequence
  source: /note="Description of Artificial Sequence: Synthetic oligonucleotide"
ugcuauaggaaauuuggucua

SEQ ID NO: 2695 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aucuucuutgtcguagugaua

SEQ ID NO: 2696 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gaucuucutugucguagugaa

SEQ ID NO: 2697 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuauugcatcacuuguauaca

SEQ ID NO: 2698 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
caacacaatutcuucuuagca

SEQ ID NO: 2699 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cuguuggaaatagguuuugaa

SEQ ID NO: 2700 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuuguagatctugcaauuaca

SEQ ID NO: 2701 - RNA, 21 nt, Artificial Sequence
  source: /note="Description of Artificial Sequence: Synthetic oligonucleotide"
ugguuucagcacagauucaga

SEQ ID NO: 2702 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uugauagutaccuaguuugca

SEQ ID NO: 2703 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acaugauctucuuugucguaa

SEQ ID NO: 2704 - RNA, 21 nt, Artificial Sequence
  source: /note="Description of Artificial Sequence: Synthetic oligonucleotide"
guuugaacacaaaucuuucga

SEQ ID NO: 2705 - RNA, 21 nt, Artificial Sequence
  source: /note="Description of Artificial Sequence: Synthetic oligonucleotide"
ugagacugacacauuguaaua

SEQ ID NO: 2706 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
augucgagtacacuuuuacua

SEQ ID NO: 2707 - RNA, 21 nt, Artificial Sequence
  source: /note="Description of Artificial Sequence: Synthetic oligonucleotide"
ugauaguuaccuaguuugcaa

SEQ ID NO: 2708 - RNA, 21 nt, Artificial Sequence
  source: /note="Description of Artificial Sequence: Synthetic oligonucleotide"
uauauuuuacaacauccguua

SEQ ID NO: 2709 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cuuuauaccatcuuagguuca

SEQ ID NO: 2710 - RNA, 21 nt, Artificial Sequence
  source: /note="Description of Artificial Sequence: Synthetic oligonucleotide"
auguacagagguuauucuaua

SEQ ID NO: 2711 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gcguuguagutccuaucucca

SEQ ID NO: 2712 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aagucaagtuccaaaucguua

SEQ ID NO: 2713 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gcaagucaagtuccaaaucga

SEQ ID NO: 2714 - RNA, 21 nt, Artificial Sequence
  source: /note="Description of Artificial Sequence: Synthetic oligonucleotide"
uuggcagaaacccugauuaua

SEQ ID NO: 2715 - RNA, 21 nt, Artificial Sequence
  source: /note="Description of Artificial Sequence: Synthetic oligonucleotide"
cugauuuccuaagaaagguga

SEQ ID NO: 2716 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucguggcucctuguuuucuga

SEQ ID NO: 2717 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gucuuuactggaaucuuugca

SEQ ID NO: 2718 - RNA, 21 nt, Artificial Sequence
  source: /note="Description of Artificial Sequence: Synthetic oligonucleotide"
cuucugaaacauccaaacuga

SEQ ID NO: 2719 - RNA, 21 nt, Artificial Sequence
  source: /note="Description of Artificial Sequence: Synthetic oligonucleotide"
uugcuauaggaaauuugguca

SEQ ID NO: 2720 - RNA, 21 nt, Artificial Sequence
  source: /note="Description of Artificial Sequence: Synthetic oligonucleotide"
agccuguuggaaauagguuua

SEQ ID NO: 2721 - RNA, 21 nt, Artificial Sequence
  source: /note="Description of Artificial Sequence: Synthetic oligonucleotide"
auguuucuagcugauuugaua

SEQ ID NO: 2722 - RNA, 21 nt, Artificial Sequence
  source: /note="Description of Artificial Sequence: Synthetic oligonucleotide"
uugcaagccucuuaugugaga

SEQ ID NO: 2723 - RNA, 21 nt, Artificial Sequence
  source: /note="Description of Artificial Sequence: Synthetic oligonucleotide"
uuuaguggcaaacacucuuga

SEQ ID NO: 2724 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gacuuacctutagaguauuga

SEQ ID NO: 2725 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ggcguuguagtuccuaucuca

SEQ ID NO: 2726 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuugucguagtgauuuuccua

SEQ ID NO: 2727 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
caacuuactutccuaaauuaa

SEQ ID NO: 2728 - RNA, 21 nt, Artificial Sequence
  source: /note="Description of Artificial Sequence: Synthetic oligonucleotide"
guauguuucuagcugauuuga

SEQ ID NO: 2729 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gacagagatgaugauuuacua

SEQ ID NO: 2730 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gagauggatucucuucguuca

SEQ ID NO: 2731 - RNA, 21 nt, Artificial Sequence
  source: /note="Description of Artificial Sequence: Synthetic oligonucleotide"
uuccugauaugcaguuaguua

SEQ ID NO: 2732 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
caccuucucctuaaaauucua

SEQ ID NO: 2733 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cugauaauagtcucuuaaaca

SEQ ID NO: 2734 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cuaaauuatggaaguaaucua

SEQ ID NO: 2735 - RNA, 21 nt, Artificial Sequence
  source: /note="Description of Artificial Sequence: Synthetic oligonucleotide"
ucuuuauaccaucuuagguua

SEQ ID NO: 2736 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ggagauggautcucuucguua

SEQ ID NO: 2737 - RNA, 21 nt, Artificial Sequence
  source: /note="Description of Artificial Sequence: Synthetic oligonucleotide"
ugaauauacaaguauuaggaa

SEQ ID NO: 2738 - RNA, 21 nt, Artificial Sequence
  source: /note="Description of Artificial Sequence: Synthetic oligonucleotide"
guuucuagcugauuugauuga

SEQ ID NO: 2739 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agucaagutccaaaucguuca

SEQ ID NO: 2740 - RNA, 21 nt, Artificial Sequence
  source: /note="Description of Artificial Sequence: Synthetic oligonucleotide"
caucuguuggaauauucuaca

SEQ ID NO: 2741 - RNA, 21 nt, Artificial Sequence
  source: /note="Description of Artificial Sequence: Synthetic oligonucleotide"
cugaaccuaugaauuccgaua

SEQ ID NO: 2742 - RNA, 21 nt, Artificial Sequence
  source: /note="Description of Artificial Sequence: Synthetic oligonucleotide"
cuuuucacaggauuguaauua

SEQ ID NO: 2743 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agcgugcutatagacguuaca

SEQ ID NO: 2744 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cuuccugatatgcaguuagua

SEQ ID NO: 2745 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ggaagaaaggtucaugucuga

SEQ ID NO: 2746 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
guagaaaacutuuacaucuga

SEQ ID NO: 2747 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucaucuuutcacaggauugua

SEQ ID NO: 2748 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gcccaaaatacugauaauaga

SEQ ID NO: 2749 - RNA, 21 nt, Artificial Sequence
  source: /note="Description of Artificial Sequence: Synthetic oligonucleotide"
uuuuacaucugccuugucaua

SEQ ID NO: 2750 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uaggcuaatgacccaagauua

SEQ ID NO: 2751 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cgugcuuatagacguuaccga

SEQ ID NO: 2752 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cuucuuagcctuguuuaggca

SEQ ID NO: 2753 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uggaauautctacuuuguuaa

SEQ ID NO: 2754 - RNA, 21 nt, Artificial Sequence
  source: /note="Description of Artificial Sequence: Synthetic oligonucleotide"
cugaauauacaaguauuagga

SEQ ID NO: 2755 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cugccaagtuaacauagagua

SEQ ID NO: 2756 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uggauucucutcguucacaga

SEQ ID NO: 2757 - RNA, 21 nt, Artificial Sequence
  source: /note="Description of Artificial Sequence: Synthetic oligonucleotide"
gcaaaggucacaauuuccuca

SEQ ID NO: 2758 - RNA, 21 nt, Artificial Sequence
  source: /note="Description of Artificial Sequence: Synthetic oligonucleotide"
ugccacugaagaaaguacuga

SEQ ID NO: 2759 - RNA, 21 nt, Artificial Sequence
  source: /note="Description of Artificial Sequence: Synthetic oligonucleotide"
ccuuccugauaugcaguuaga

SEQ ID NO: 2760 - RNA, 21 nt, Artificial Sequence
  source: /note="Description of Artificial Sequence: Synthetic oligonucleotide"
caucuuuucacaggauuguaa

SEQ ID NO: 2761 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gggagauggatucucuucgua

SEQ ID NO: 2762 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaugucggactugguuaccua

SEQ ID NO: 2763 - RNA, 21 nt, Artificial Sequence
  source: /note="Description of Artificial Sequence: Synthetic oligonucleotide"
ucauccuggaaguucaguuga

SEQ ID NO: 2764 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auguauautugaccuagugaa

SEQ ID NO: 2765 - RNA, 21 nt, Artificial Sequence
  source: /note="Description of Artificial Sequence: Synthetic oligonucleotide"
agucaccacucagcauucgua

SEQ ID NO: 2766 - RNA, 21 nt, Artificial Sequence
  source: /note="Description of Artificial Sequence: Synthetic oligonucleotide"
aucguaagagaacucuguaga

SEQ ID NO: 2767 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gcugaacctatgaauuccgaa

SEQ ID NO: 2768 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cggacuuggutaccuaucuca

SEQ ID NO: 2769 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agauggautctcuucguucaa

SEQ ID NO: 2770 - RNA, 21 nt, Artificial Sequence
  source: /note="Description of Artificial Sequence: Synthetic oligonucleotide"
agacguuaccgcuuaaggcaa

SEQ ID NO: 2771 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uguagauctugcaauuaccaa

SEQ ID NO: 2772 - RNA, 21 nt, Artificial Sequence
  source: /note="Description of Artificial Sequence: Synthetic oligonucleotide"
uugcccuuaugaauguuagua

SEQ ID NO: 2773 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucactaaacuuaaagtcacaaua

SEQ ID NO: 2774 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucuaaacuuaaagtcacaauaag

SEQ ID NO: 2775 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugugaatucuccuacacagaagc

SEQ ID NO: 2776 - RNA, 23 nt, Artificial Sequence
  source: /note="Description of Artificial Sequence: Synthetic oligonucleotide"
ucuacgacaaagaagaucaugua

SEQ ID NO: 2777 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugaaaagugaatucuccuacaca

SEQ ID NO: 2778 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucagtaaaaguguactcgacauu

SEQ ID NO: 2779 - RNA, 23 nt, Artificial Sequence
  source: /note="Description of Artificial Sequence: Synthetic oligonucleotide"
uacuacgacaaagaagaucaugu

SEQ ID NO: 2780 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucggcaaauucagtctcagaucc

SEQ ID NO: 2781 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucactacgacaaagaagaucaug

SEQ ID NO: 2782 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uacggaagauugututcccuuug

SEQ ID NO: 2783 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uguctaauuuuactucaagcuua

SEQ ID NO: 2784 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uagaccaaauutccuauagcaag

SEQ ID NO: 2785 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uaucactacgacaaagaagauca

SEQ ID NO: 2786 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
utcacuacgacaaagaagaucau

SEQ ID NO: 2787 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uguatacaagugatgcaauaaau

SEQ ID NO: 2788 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugcuaagaagaaatuguguuguu

SEQ ID NO: 2789 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
utcaaaaccuatutccaacaggc

SEQ ID NO: 2790 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uguaautgcaagatctacaaaag

SEQ ID NO: 2791 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucugaatcugugctgaaaccaca

SEQ ID NO: 2792 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugcaaacuaggtaactaucaaaa

SEQ ID NO: 2793 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
utacgacaaagaagatcauguag

SEQ ID NO: 2794 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucgaaagauuugugutcaaaccu

SEQ ID NO: 2795 - RNA, 23 nt, Artificial Sequence
  source: /note="Description of Artificial Sequence: Synthetic oligonucleotide"
uauuacaaugugucagucucaag

SEQ ID NO: 2796 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uaguaaaagugtacucgacauuu

SEQ ID NO: 2797 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
utgcaaacuagguaacuaucaaa

SEQ ID NO: 2798 - RNA, 23 nt, Artificial Sequence
  source: /note="Description of Artificial Sequence: Synthetic oligonucleotide"
uaacggauguuguaaaauauauc

SEQ ID NO: 2799 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugaacctaagatgguauaaagaa

SEQ ID NO: 2800 - RNA, 23 nt, Artificial Sequence
  source: /note="Description of Artificial Sequence: Synthetic oligonucleotide"
uauagaauaaccucuguacauug

SEQ ID NO: 2801 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uggagataggaactacaacgccu

SEQ ID NO: 2802 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uaacgatuuggaacutgacuugc

SEQ ID NO: 2803 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucgatutggaacutgacuugcag

SEQ ID NO: 2804 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uauaaucagggtutctgccaauu

SEQ ID NO: 2805 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucaccutucuuaggaaaucagag

SEQ ID NO: 2806 - RNA, 23 nt, Artificial Sequence
  source: /note="Description of Artificial Sequence: Synthetic oligonucleotide"
ucagaaaacaaggagccacgaau

SEQ ID NO: 2807 - RNA, 23 nt, Artificial Sequence
  source: /note="Description of Artificial Sequence: Synthetic oligonucleotide"
ugcaaagauuccaguaaagacca

SEQ ID NO: 2808 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucagtutggaugutucagaagaa

SEQ ID NO: 2809 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugaccaaauuucctatagcaagu

SEQ ID NO: 2810 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uaaacctauuuccaacaggcuug

SEQ ID NO: 2811 - RNA, 23 nt, Artificial Sequence
  source: /note="Description of Artificial Sequence: Synthetic oligonucleotide"
uaucaaaucagcuagaaacauac

SEQ ID NO: 2812 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucucacauaagaggctugcaacc

SEQ ID NO: 2813 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucaagaguguutgccacuaaagu

SEQ ID NO: 2814 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucaatacucuaaaggtaagucuu

SEQ ID NO: 2815 - RNA, 23 nt, Artificial Sequence
  source: /note="Description of Artificial Sequence: Synthetic oligonucleotide"
ugagauaggaacuacaacgccuu

SEQ ID NO: 2816 - RNA, 23 nt, Artificial Sequence
  source: /note="Description of Artificial Sequence: Synthetic oligonucleotide"
uaggaaaaucacuacgacaaaga

SEQ ID NO: 2817 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
utaatutaggaaaguaaguuggu

SEQ ID NO: 2818 - RNA, 23 nt, Artificial Sequence
  source: /note="Description of Artificial Sequence: Synthetic oligonucleotide"
ucaaaucagcuagaaacauaccu

SEQ ID NO: 2819 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uaguaaaucaucatctcugucuc

SEQ ID NO: 2820 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugaacgaagagaatccaucuccc

SEQ ID NO: 2821 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uaactaacugcauaucaggaagg

SEQ ID NO: 2822 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uagaautuuaaggagaaggugac

SEQ ID NO: 2823 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uguutaagagacuautaucagua

SEQ ID NO: 2824 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uagatuacuuccataauuuagga

SEQ ID NO: 2825 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uaaccuaagauggtataaagaau

SEQ ID NO: 2826 - RNA, 23 nt, Artificial Sequence
  source: /note="Description of Artificial Sequence: Synthetic oligonucleotide"
uaacgaagagaauccaucucccc

SEQ ID NO: 2827 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
utcctaauacutgtatauucagc

SEQ ID NO: 2828 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucaatcaaaucagcuagaaacau

SEQ ID NO: 2829 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugaacgauuuggaactugacuug

SEQ ID NO: 2830 - RNA, 23 nt, Artificial Sequence
  source: /note="Description of Artificial Sequence: Synthetic oligonucleotide"
uguagaauauuccaacagauggg

SEQ ID NO: 2831 - RNA, 23 nt, Artificial Sequence
  source: /note="Description of Artificial Sequence: Synthetic oligonucleotide"
uaucggaauucauagguucagcc

SEQ ID NO: 2832 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uaautacaauccugugaaaagau

SEQ ID NO: 2833 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uguaacgucuataagcacgcuga

SEQ ID NO: 2834 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uacuaacugcatatcaggaagga

SEQ ID NO: 2835 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucagacaugaacctutcuuccau

SEQ ID NO: 2836 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucagauguaaaagtutucuacau

SEQ ID NO: 2837 - RNA, 23 nt, Artificial Sequence
  source: /note="Description of Artificial Sequence: Synthetic oligonucleotide"
uacaauccugugaaaagaugaca

SEQ ID NO: 2838 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucuatuaucagtatutugggcag

SEQ ID NO: 2839 - RNA, 23 nt, Artificial Sequence
  source: /note="Description of Artificial Sequence: Synthetic oligonucleotide"
uaugacaaggcagauguaaaagu

SEQ ID NO: 2840 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uaaucutgggucatuagccuaaa

SEQ ID NO: 2841 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucggtaacguctataagcacgcu

SEQ ID NO: 2842 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugcctaaacaaggcuaagaaggc

SEQ ID NO: 2843 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
utaacaaaguagaauauuccaac

SEQ ID NO: 2844 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uccuaatacuuguauauucagcc

SEQ ID NO: 2845 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uacucuauguuaacutggcagca

SEQ ID NO: 2846 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucugtgaacgaagagaauccauc

SEQ ID NO: 2847 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugaggaaauugtgaccuuugcuc

SEQ ID NO: 2848 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucagtacuuuctucaguggcaac

SEQ ID NO: 2849 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucuaactgcauaucaggaaggau

SEQ ID NO: 2850 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
utacaatccugtgaaaagaugac

SEQ ID NO: 2851 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uacgaagagaatccatcucccca

SEQ ID NO: 2852 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uaggtaaccaaguccgacauuau

SEQ ID NO: 2853 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucaacugaacutccaggaugaac

SEQ ID NO: 2854 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
utcacuaggucaaauauacaucc

SEQ ID NO: 2855 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uacgaatgcugagtggugacuga

SEQ ID NO: 2856 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucuacagaguucucutacgauuc

SEQ ID NO: 2857 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
utcggaauucataggtucagccu

SEQ ID NO: 2858 - RNA, 23 nt, Artificial Sequence
  source: /note="Description of Artificial Sequence: Synthetic oligonucleotide"
ugagauagguaaccaaguccgac

SEQ ID NO: 2859 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
utgaacgaagagaauccaucucc

SEQ ID NO: 2860 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
utgccutaagcggtaacgucuau

SEQ ID NO: 2861 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
utggtaauugcaagatcuacaaa

SEQ ID NO: 2862 - RNA, 23 nt, Artificial Sequence
  source: /note="Description of Artificial Sequence: Synthetic oligonucleotide"
uacuaacauucauaagggcaaaa

SEQ ID NO: 2863 - RNA, 21 nt, Artificial Sequence
  source: /note="Description of Artificial Sequence: Synthetic oligonucleotide"
ugguuucagcacagauucaga

SEQ ID NO: 2864 - RNA, 21 nt, Artificial Sequence
  source: /note="Description of Artificial Sequence: Synthetic oligonucleotide"
uguaggagaauucacuuuuca

SEQ ID NO: 2865 - RNA, 21 nt, Artificial Sequence
  source: /note="Description of Artificial Sequence: Synthetic oligonucleotide"
uuuguagaucuugcaauuaca

SEQ ID NO: 2866 - RNA, 21 nt, Artificial Sequence
  source: /note="Description of Artificial Sequence: Synthetic oligonucleotide"
guuugaacacaaaucuuucga

SEQ ID NO: 2867 - RNA, 21 nt, Artificial Sequence
  source: /note="Description of Artificial Sequence: Synthetic oligonucleotide"
cuucugaaacauccaaacuga

SEQ ID NO: 2868 - RNA, 21 nt, Artificial Sequence
  source: /note="Description of Artificial Sequence: Synthetic oligonucleotide"
agucaaguuccaaaucguuca

SEQ ID NO: 2869 - RNA, 21 nt, Artificial Sequence
  source: /note="Description of Artificial Sequence: Synthetic oligonucleotide"
gaucuucuuugucguagugaa

SEQ ID NO: 2870 - RNA, 21 nt, Artificial Sequence
  source: /note="Description of Artificial Sequence: Synthetic oligonucleotide"
ugucgaguacacuuuuacuga

SEQ ID NO: 2871 - RNA, 21 nt, Artificial Sequence
  source: /note="Description of Artificial Sequence: Synthetic oligonucleotide"
caugaucuucuuugucguaga

SEQ ID NO: 2872 - RNA, 21 nt, Artificial Sequence
  source: /note="Description of Artificial Sequence: Synthetic oligonucleotide"
aagggaaaacaaucuuccgua

SEQ ID NO: 2873 - RNA, 21 nt, Artificial Sequence
  source: /note="Description of Artificial Sequence: Synthetic oligonucleotide"
agauggauucucuucguucaa

SEQ ID NO: 2874 - RNA, 21 nt, Artificial Sequence
  source: /note="Description of Artificial Sequence: Synthetic oligonucleotide"
ugauaguuaccuaguuugcaa

SEQ ID NO: 2875 - RNA, 21 nt, Artificial Sequence
  source: /note="Description of Artificial Sequence: Synthetic oligonucleotide"
uauauuuuacaacauccguua

SEQ ID NO: 2876 - RNA, 21 nt, Artificial Sequence
  source: /note="Description of Artificial Sequence: Synthetic oligonucleotide"
uugcuauaggaaauuugguca

SEQ ID NO: 2877 - RNA, 21 nt, Artificial Sequence
  source: /note="Description of Artificial Sequence: Synthetic oligonucleotide"
aucuucuuugucguagugaua

SEQ ID NO: 2878 - RNA, 21 nt, Artificial Sequence
  source: /note="Description of Artificial Sequence: Synthetic oligonucleotide"
aucguaagagaacucuguaga

SEQ ID NO: 2879 - RNA, 21 nt, Artificial Sequence
  source: /note="Description of Artificial Sequence: Synthetic oligonucleotide"
gcguuguaguuccuaucucca

SEQ ID NO: 2880 - RNA, 21 nt, Artificial Sequence
  source: /note="Description of Artificial Sequence: Synthetic oligonucleotide"
augaucuucuuugucguagua

SEQ ID NO: 2881 - RNA, 21 nt, Artificial Sequence
  source: /note="Description of Artificial Sequence: Synthetic oligonucleotide"
gcuguuuacauaggauucuua

SEQ ID NO: 2882 - RNA, 21 nt, Artificial Sequence
  source: /note="Description of Artificial Sequence: Synthetic oligonucleotide"
caccuucuccuuaaaauucua

SEQ ID NO: 2883 - RNA, 21 nt, Artificial Sequence
  source: /note="Description of Artificial Sequence: Synthetic oligonucleotide"
uugugacuuuaaguuuaguga

SEQ ID NO: 2884 - RNA, 21 nt, Artificial Sequence
  source: /note="Description of Artificial Sequence: Synthetic oligonucleotide"
ucuuuauaccaucuuagguua

SEQ ID NO: 2885 - RNA, 21 nt, Artificial Sequence
  source: /note="Description of Artificial Sequence: Synthetic oligonucleotide"
gagauggauucucuucguuca

SEQ ID NO: 2886 - RNA, 21 nt, Artificial Sequence
  source: /note="Description of Artificial Sequence: Synthetic oligonucleotide"
uugauaguuaccuaguuugca

SEQ ID NO: 2887 - RNA, 21 nt, Artificial Sequence
  source: /note="Description of Artificial Sequence: Synthetic oligonucleotide"
gacagagaugaugauuuacua

SEQ ID NO: 2888 - RNA, 21 nt, Artificial Sequence
  source: /note="Description of Artificial Sequence: Synthetic oligonucleotide"
auguacagagguuauucuaua

SEQ ID NO: 2889 - RNA, 21 nt, Artificial Sequence
  source: /note="Description of Artificial Sequence: Synthetic oligonucleotide"
auguuucuagcugauuugaua

SEQ ID NO: 2890 - RNA, 21 nt, Artificial Sequence
  source: /note="Description of Artificial Sequence: Synthetic oligonucleotide"
caacacaauuucuucuuagca

SEQ ID NO: 2891 - RNA, 21 nt, Artificial Sequence
  source: /note="Description of Artificial Sequence: Synthetic oligonucleotide"
gcaagucaaguuccaaaucga

SEQ ID NO: 2892 - RNA, 21 nt, Artificial Sequence
  source: /note="Description of Artificial Sequence: Synthetic oligonucleotide"
aaugucggacuugguuaccua

SEQ ID NO: 2893 - RNA, 21 nt, Artificial Sequence
  source: /note="Description of Artificial Sequence: Synthetic oligonucleotide"
caucuguuggaauauucuaca

SEQ ID NO: 2894 - RNA, 21 nt, Artificial Sequence
  source: /note="Description of Artificial Sequence: Synthetic oligonucleotide"
uggaauauucuacuuuguuaa

SEQ ID NO: 2895 - RNA, 21 nt, Artificial Sequence
  source: /note="Description of Artificial Sequence: Synthetic oligonucleotide"
cugauaauagucucuuaaaca

SEQ ID NO: 2896 - RNA, 21 nt, Artificial Sequence
  source: /note="Description of Artificial Sequence: Synthetic oligonucleotide"
uuggcagaaacccugauuaua

SEQ ID NO: 2897 - RNA, 21 nt, Artificial Sequence
  source: /note="Description of Artificial Sequence: Synthetic oligonucleotide"
gcaaaggucacaauuuccuca

SEQ ID NO: 2898 - RNA, 21 nt, Artificial Sequence
  source: /note="Description of Artificial Sequence: Synthetic oligonucleotide"
cugaaccuaugaauuccgaua

SEQ ID NO: 2899 - RNA, 21 nt, Artificial Sequence
  source: /note="Description of Artificial Sequence: Synthetic oligonucleotide"
ggaagaaagguucaugucuga

SEQ ID NO: 2900 - RNA, 21 nt, Artificial Sequence
  source: /note="Description of Artificial Sequence: Synthetic oligonucleotide"
agccuguuggaaauagguuua

SEQ ID NO: 2901 - RNA, 21 nt, Artificial Sequence
  source: /note="Description of Artificial Sequence: Synthetic oligonucleotide"
uuauugcaucacuuguauaca

SEQ ID NO: 2902 - RNA, 21 nt, Artificial Sequence
  source: /note="Description of Artificial Sequence: Synthetic oligonucleotide"
cuguuggaaauagguuuugaa

SEQ ID NO: 2903 - RNA, 21 nt, Artificial Sequence
  source: /note="Description of Artificial Sequence: Synthetic oligonucleotide"
aucugagacugaauuugccga

SEQ ID NO: 2904 - RNA, 21 nt, Artificial Sequence
  source: /note="Description of Artificial Sequence: Synthetic oligonucleotide"
agcgugcuuauagacguuaca

SEQ ID NO: 2905 - RNA, 21 nt, Artificial Sequence
  source: /note="Description of Artificial Sequence: Synthetic oligonucleotide"
ccuuccugauaugcaguuaga

SEQ ID NO: 2906 - RNA, 21 nt, Artificial Sequence
  source: /note="Description of Artificial Sequence: Synthetic oligonucleotide"
guagaaaacuuuuacaucuga

SEQ ID NO: 2907 - RNA, 21 nt, Artificial Sequence
  source: /note="Description of Artificial Sequence: Synthetic oligonucleotide"
gcccaaaauacugauaauaga

SEQ ID NO: 2908 - RNA, 21 nt, Artificial Sequence
  source: /note="Description of Artificial Sequence: Synthetic oligonucleotide"
gucuuuacuggaaucuuugca

SEQ ID NO: 2909 - RNA, 21 nt, Artificial Sequence
  source: /note="Description of Artificial Sequence: Synthetic oligonucleotide"
agcuugaaguaaaauuagaca

SEQ ID NO: 2910 - RNA, 21 nt, Artificial Sequence
  source: /note="Description of Artificial Sequence: Synthetic oligonucleotide"
uggauucucuucguucacaga

SEQ ID NO: 2911 - RNA, 21 nt, Artificial Sequence
  source: /note="Description of Artificial Sequence: Synthetic oligonucleotide"
uuuaguggcaaacacucuuga

SEQ ID NO: 2912 - RNA, 21 nt, Artificial Sequence
  source: /note="Description of Artificial Sequence: Synthetic oligonucleotide"
acaugaucuucuuugucguaa

SEQ ID NO: 2913 - RNA, 21 nt, Artificial Sequence
  source: /note="Description of Artificial Sequence: Synthetic oligonucleotide"
caucuuuucacaggauuguaa

SEQ ID NO: 2914 - RNA, 21 nt, Artificial Sequence
  source: /note="Description of Artificial Sequence: Synthetic oligonucleotide"
cugauuuccuaagaaagguga

SEQ ID NO: 2915 - RNA, 21 nt, Artificial Sequence
  source: /note="Description of Artificial Sequence: Synthetic oligonucleotide"
cuuuauaccaucuuagguuca

SEQ ID NO: 2916 - RNA, 21 nt, Artificial Sequence
  source: /note="Description of Artificial Sequence: Synthetic oligonucleotide"
cgugcuuauagacguuaccga

SEQ ID NO: 2917 - RNA, 21 nt, Artificial Sequence
  source: /note="Description of Artificial Sequence: Synthetic oligonucleotide"
aagucaaguuccaaaucguua

SEQ ID NO: 2918 - RNA, 21 nt, Artificial Sequence
  source: /note="Description of Artificial Sequence: Synthetic oligonucleotide"
cugaauauacaaguauuagga

SEQ ID NO: 2919 - RNA, 21 nt, Artificial Sequence
  source: /note="Description of Artificial Sequence: Synthetic oligonucleotide"
ucguggcuccuuguuuucuga

SEQ ID NO: 2920 - RNA, 21 nt, Artificial Sequence
  source: /note="Description of Artificial Sequence: Synthetic oligonucleotide"
agacguuaccgcuuaaggcaa

SEQ ID NO: 2921 - RNA, 21 nt, Artificial Sequence
  source: /note="Description of Artificial Sequence: Synthetic oligonucleotide"
ucaucuuuucacaggauugua

SEQ ID NO: 2922 - RNA, 21 nt, Artificial Sequence
  source: /note="Description of Artificial Sequence: Synthetic oligonucleotide"
uuuuacaucugccuugucaua

SEQ ID NO: 2923 - RNA, 21 nt, Artificial Sequence
  source: /note="Description of Artificial Sequence: Synthetic oligonucleotide"
cuuccugauaugcaguuagua

SEQ ID NO: 2924 - RNA, 21 nt, Artificial Sequence
  source: /note="Description of Artificial Sequence: Synthetic oligonucleotide"
ugaauauacaaguauuaggaa

SEQ ID NO: 2925 - RNA, 21 nt, Artificial Sequence
  source: /note="Description of Artificial Sequence: Synthetic oligonucleotide"
guuucuagcugauuugauuga

SEQ ID NO: 2926 - RNA, 21 nt, Artificial Sequence
  source: /note="Description of Artificial Sequence: Synthetic oligonucleotide"
ugccacugaagaaaguacuga

SEQ ID NO: 2927 - RNA, 21 nt, Artificial Sequence
  source: /note="Description of Artificial Sequence: Synthetic oligonucleotide"
ugaucuucuuugucguaguga

SEQ ID NO: 2928 - RNA, 21 nt, Artificial Sequence
  source: /note="Description of Artificial Sequence: Synthetic oligonucleotide"
ucauccuggaaguucaguuga

SEQ ID NO: 2929 - RNA, 21 nt, Artificial Sequence
  source: /note="Description of Artificial Sequence: Synthetic oligonucleotide"
auguauauuugaccuagugaa

SEQ ID NO: 2930 - RNA, 21 nt, Artificial Sequence
  source: /note="Description of Artificial Sequence: Synthetic oligonucleotide"
augucgaguacacuuuuacua

SEQ ID NO: 2931 - RNA, 21 nt, Artificial Sequence
  source: /note="Description of Artificial Sequence: Synthetic oligonucleotide"
uauugugacuuuaaguuuaga

SEQ ID NO: 2932 - RNA, 21 nt, Artificial Sequence
  source: /note="Description of Artificial Sequence: Synthetic oligonucleotide"
guauguuucuagcugauuuga

SEQ ID NO: 2933 - RNA, 21 nt, Artificial Sequence
  source: /note="Description of Artificial Sequence: Synthetic oligonucleotide"
gggagauggauucucuucgua

SEQ ID NO: 2934 - RNA, 21 nt, Artificial Sequence
  source: /note="Description of Artificial Sequence: Synthetic oligonucleotide"
uuccugauaugcaguuaguua

SEQ ID NO: 2935 - RNA, 21 nt, Artificial Sequence
  source: /note="Description of Artificial Sequence: Synthetic oligonucleotide"
caacuuacuuuccuaaauuaa

SEQ ID NO: 2936 - RNA, 21 nt, Artificial Sequence
  source: /note="Description of Artificial Sequence: Synthetic oligonucleotide"
ugcuauaggaaauuuggucua

SEQ ID NO: 2937 - RNA, 21 nt, Artificial Sequence
  source: /note="Description of Artificial Sequence: Synthetic oligonucleotide"
cuaaauuauggaaguaaucua

SEQ ID NO: 2938 - RNA, 21 nt, Artificial Sequence
  source: /note="Description of Artificial Sequence: Synthetic oligonucleotide"
gacuuaccuuuagaguauuga

SEQ ID NO: 2939 - RNA, 21 nt, Artificial Sequence
  source: /note="Description of Artificial Sequence: Synthetic oligonucleotide"
cggacuugguuaccuaucuca

SEQ ID NO: 2940 - RNA, 21 nt, Artificial Sequence
  source: /note="Description of Artificial Sequence: Synthetic oligonucleotide"
agucaccacucagcauucgua

SEQ ID NO: 2941 - RNA, 21 nt, Artificial Sequence
  source: /note="Description of Artificial Sequence: Synthetic oligonucleotide"
uugcccuuaugaauguuagua

SEQ ID NO: 2942 - RNA, 21 nt, Artificial Sequence
  source: /note="Description of Artificial Sequence: Synthetic oligonucleotide"
cuuuucacaggauuguaauua

SEQ ID NO: 2943 - RNA, 21 nt, Artificial Sequence
  source: /note="Description of Artificial Sequence: Synthetic oligonucleotide"
gcugaaccuaugaauuccgaa

SEQ ID NO: 2944 - RNA, 21 nt, Artificial Sequence
  source: /note="Description of Artificial Sequence: Synthetic oligonucleotide"
cuucuuagccuuguuuaggca

SEQ ID NO: 2945 - RNA, 21 nt, Artificial Sequence
  source: /note="Description of Artificial Sequence: Synthetic oligonucleotide"
cugccaaguuaacauagagua

SEQ ID NO: 2946 - RNA, 21 nt, Artificial Sequence
  source: /note="Description of Artificial Sequence: Synthetic oligonucleotide"
uguagaucuugcaauuaccaa

SEQ ID NO: 2947 - RNA, 21 nt, Artificial Sequence
  source: /note="Description of Artificial Sequence: Synthetic oligonucleotide"
uaggcuaaugacccaagauua

SEQ ID NO: 2948 - RNA, 21 nt, Artificial Sequence
  source: /note="Description of Artificial Sequence: Synthetic oligonucleotide"
uuugucguagugauuuuccua

SEQ ID NO: 2949 - RNA, 21 nt, Artificial Sequence
  source: /note="Description of Artificial Sequence: Synthetic oligonucleotide"
uugcaagccucuuaugugaga

SEQ ID NO: 2950 - RNA, 23 nt, Artificial Sequence
  source: /note="Description of Artificial Sequence: Synthetic oligonucleotide"
ugagauaggaacuacaacgccuu

SEQ ID NO: 2951 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugugaatucuccuacacagaagc

SEQ ID NO: 2952 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucugaatcugugcugaaaccaca

SEQ ID NO: 2953 - RNA, 23 nt, Artificial Sequence
  source: /note="Description of Artificial Sequence: Synthetic oligonucleotide"
ugaaaagugaauucuccuacaca

SEQ ID NO: 2954 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uguaautgcaagaucuacaaaag

SEQ ID NO: 2955 - RNA, 23 nt, Artificial Sequence
  source: /note="Description of Artificial Sequence: Synthetic oligonucleotide"
ucgaaagauuuguguucaaaccu

SEQ ID NO: 2956 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucaguutggauguuucagaagaa

SEQ ID NO: 2957 - RNA, 23 nt, Artificial Sequence
  source: /note="Description of Artificial Sequence: Synthetic oligonucleotide"
ugaacgauuuggaacuugacuug

SEQ ID NO: 2958 - RNA, 23 nt, Artificial Sequence
  source: /note="Description of Artificial Sequence: Synthetic oligonucleotide"
uucacuacgacaaagaagaucau

SEQ ID NO: 2959 - RNA, 23 nt, Artificial Sequence
  source: /note="Description of Artificial Sequence: Synthetic oligonucleotide"
ucaguaaaaguguacucgacauu

SEQ ID NO: 2960 - RNA, 23 nt, Artificial Sequence
  source: /note="Description of Artificial Sequence: Synthetic oligonucleotide"
ucuacgacaaagaagaucaugua

SEQ ID NO: 2961 - RNA, 23 nt, Artificial Sequence
  source: /note="Description of Artificial Sequence: Synthetic oligonucleotide"
uacggaagauuguuuucccuuug

SEQ ID NO: 2962 - RNA, 23 nt, Artificial Sequence
  source: /note="Description of Artificial Sequence: Synthetic oligonucleotide"
uugaacgaagagaauccaucucc

SEQ ID NO: 2963 - RNA, 23 nt, Artificial Sequence
  source: /note="Description of Artificial Sequence: Synthetic oligonucleotide"
uugcaaacuagguaacuaucaaa

SEQ ID NO: 2964 - RNA, 23 nt, Artificial Sequence
  source: /note="Description of Artificial Sequence: Synthetic oligonucleotide"
uaacggauguuguaaaauauauc

SEQ ID NO: 2965 - RNA, 23 nt, Artificial Sequence
  source: /note="Description of Artificial Sequence: Synthetic oligonucleotide"
ugaccaaauuuccuauagcaagu

SEQ ID NO: 2966 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uaucactacgacaaagaagauca

SEQ ID NO: 2967 - RNA, 23 nt, Artificial Sequence
  source: /note="Description of Artificial Sequence: Synthetic oligonucleotide"
ucuacagaguucucuuacgauuc

SEQ ID NO: 2968 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uggagataggaacuacaacgccu

SEQ ID NO: 2969 - RNA, 23 nt, Artificial Sequence
  source: /note="Description of Artificial Sequence: Synthetic oligonucleotide"
uacuacgacaaagaagaucaugu

SEQ ID NO: 2970 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uaagaatccuauguaaacagcuu

SEQ ID NO: 2971 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uagaautuuaaggagaaggugac

SEQ ID NO: 2972 - RNA, 23 nt, Artificial Sequence
  source: /note="Description of Artificial Sequence: Synthetic oligonucleotide"
ucacuaaacuuaaagucacaaua

SEQ ID NO: 2973 - RNA, 23 nt, Artificial Sequence
  source: /note="Description of Artificial Sequence: Synthetic oligonucleotide"
uaaccuaagaugguauaaagaau

SEQ ID NO: 2974 - RNA, 23 nt, Artificial Sequence
  source: /note="Description of Artificial Sequence: Synthetic oligonucleotide"
ugaacgaagagaauccaucuccc

SEQ ID NO: 2975 - RNA, 23 nt, Artificial Sequence
  source: /note="Description of Artificial Sequence: Synthetic oligonucleotide"
ugcaaacuagguaacuaucaaaa

SEQ ID NO: 2976 - RNA, 23 nt, Artificial Sequence
  source: /note="Description of Artificial Sequence: Synthetic oligonucleotide"
uaguaaaucaucaucucugucuc

SEQ ID NO: 2977 - RNA, 23 nt, Artificial Sequence
  source: /note="Description of Artificial Sequence: Synthetic oligonucleotide"
uauagaauaaccucuguacauug

SEQ ID NO: 2978 - RNA, 23 nt, Artificial Sequence
  source: /note="Description of Artificial Sequence: Synthetic oligonucleotide"
uaucaaaucagcuagaaacauac

SEQ ID NO: 2979 - RNA, 23 nt, Artificial Sequence
  source: /note="Description of Artificial Sequence: Synthetic oligonucleotide"
ugcuaagaagaaauuguguuguu

SEQ ID NO: 2980 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucgauutggaacuugacuugcag

SEQ ID NO: 2981 - RNA, 23 nt, Artificial Sequence
  source: /note="Description of Artificial Sequence: Synthetic oligonucleotide"
uagguaaccaaguccgacauuau

SEQ ID NO: 2982 - RNA, 23 nt, Artificial Sequence
  source: /note="Description of Artificial Sequence: Synthetic oligonucleotide"
uguagaauauuccaacagauggg

SEQ ID NO: 2983 - RNA, 23 nt, Artificial Sequence
  source: /note="Description of Artificial Sequence: Synthetic oligonucleotide"
uuaacaaaguagaauauuccaac

SEQ ID NO: 2984 - RNA, 23 nt, Artificial Sequence
  source: /note="Description of Artificial Sequence: Synthetic oligonucleotide"
uguuuaagagacuauuaucagua

SEQ ID NO: 2985 - RNA, 23 nt, Artificial Sequence
  source: /note="Description of Artificial Sequence: Synthetic oligonucleotide"
uauaaucaggguuucugccaauu

SEQ ID NO: 2986 - RNA, 23 nt, Artificial Sequence
  source: /note="Description of Artificial Sequence: Synthetic oligonucleotide"
ugaggaaauugugaccuuugcuc

SEQ ID NO: 2987 - RNA, 23 nt, Artificial Sequence
  source: /note="Description of Artificial Sequence: Synthetic oligonucleotide"
uaucggaauucauagguucagcc

SEQ ID NO: 2988 - RNA, 23 nt, Artificial Sequence
  source: /note="Description of Artificial Sequence: Synthetic oligonucleotide"
ucagacaugaaccuuucuuccau

SEQ ID NO: 2989 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uaaacctauuuccaacaggcuug

SEQ ID NO: 2990 - RNA, 23 nt, Artificial Sequence
  source: /note="Description of Artificial Sequence: Synthetic oligonucleotide"
uguauacaagugaugcaauaaau

SEQ ID NO: 2991 - RNA, 23 nt, Artificial Sequence
  source: /note="Description of Artificial Sequence: Synthetic oligonucleotide"
uucaaaaccuauuuccaacaggc

SEQ ID NO: 2992 - RNA, 23 nt, Artificial Sequence
  source: /note="Description of Artificial Sequence: Synthetic oligonucleotide"
ucggcaaauucagucucagaucc

SEQ ID NO: 2993 - RNA, 23 nt, Artificial Sequence
  source: /note="Description of Artificial Sequence: Synthetic oligonucleotide"
uguaacgucuauaagcacgcuga

SEQ ID NO: 2994 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucuaactgcauaucaggaaggau

SEQ ID NO: 2995 - RNA, 23 nt, Artificial Sequence
  source: /note="Description of Artificial Sequence: Synthetic oligonucleotide"
ucagauguaaaaguuuucuacau

SEQ ID NO: 2996 - RNA, 23 nt, Artificial Sequence
  source: /note="Description of Artificial Sequence: Synthetic oligonucleotide"
ucuauuaucaguauuuugggcag

SEQ ID NO: 2997 - RNA, 23 nt, Artificial Sequence
  source: /note="Description of Artificial Sequence: Synthetic oligonucleotide"
ugcaaagauuccaguaaagacca

SEQ ID NO: 2998 - RNA, 23 nt, Artificial Sequence
  source: /note="Description of Artificial Sequence: Synthetic oligonucleotide"
ugucuaauuuuacuucaagcuua

SEQ ID NO: 2999 - RNA, 23 nt, Artificial Sequence
  source: /note="Description of Artificial Sequence: Synthetic oligonucleotide"
ucugugaacgaagagaauccauc

SEQ ID NO: 3000 - RNA, 23 nt, Artificial Sequence
  source: /note="Description of Artificial Sequence: Synthetic oligonucleotide"
ucaagaguguuugccacuaaagu

SEQ ID NO: 3001 - RNA, 23 nt, Artificial Sequence
  source: /note="Description of Artificial Sequence: Synthetic oligonucleotide"
uuacgacaaagaagaucauguag

SEQ ID NO: 3002 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uuacaatccugugaaaagaugac

SEQ ID NO: 3003 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucaccutucuuaggaaaucagag

SEQ ID NO: 3004 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugaacctaagaugguauaaagaa

SEQ ID NO: 3005 - RNA, 23 nt, Artificial Sequence
  source: /note="Description of Artificial Sequence: Synthetic oligonucleotide"
ucgguaacgucuauaagcacgcu

SEQ ID NO: 3006 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uaacgatuuggaacuugacuugc

SEQ ID NO: 3007 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uccuaatacuuguauauucagcc

SEQ ID NO: 3008 - RNA, 23 nt, Artificial Sequence
  source: /note="Description of Artificial Sequence: Synthetic oligonucleotide"
ucagaaaacaaggagccacgaau

SEQ ID NO: 3009 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uugccutaagcgguaacgucuau

SEQ ID NO: 3010 - RNA, 23 nt, Artificial Sequence
  source: /note="Description of Artificial Sequence: Synthetic oligonucleotide"
uacaauccugugaaaagaugaca

SEQ ID NO: 3011 - RNA, 23 nt, Artificial Sequence
  source: /note="Description of Artificial Sequence: Synthetic oligonucleotide"
uaugacaaggcagauguaaaagu

SEQ ID NO: 3012 - RNA, 23 nt, Artificial Sequence
  source: /note="Description of Artificial Sequence: Synthetic oligonucleotide"
uacuaacugcauaucaggaagga

SEQ ID NO: 3013 - RNA, 23 nt, Artificial Sequence
  source: /note="Description of Artificial Sequence: Synthetic oligonucleotide"
uuccuaauacuuguauauucagc

SEQ ID NO: 3014 - RNA, 23 nt, Artificial Sequence
  source: /note="Description of Artificial Sequence: Synthetic oligonucleotide"
ucaaucaaaucagcuagaaacau

SEQ ID NO: 3015 - RNA, 23 nt, Artificial Sequence
  source: /note="Description of Artificial Sequence: Synthetic oligonucleotide"
ucaguacuuucuucaguggcaac

SEQ ID NO: 3016 - RNA, 23 nt, Artificial Sequence
  source: /note="Description of Artificial Sequence: Synthetic oligonucleotide"
ucacuacgacaaagaagaucaug

SEQ ID NO: 3017 - RNA, 23 nt, Artificial Sequence
  source: /note="Description of Artificial Sequence: Synthetic oligonucleotide"
ucaacugaacuuccaggaugaac

SEQ ID NO: 3018 - RNA, 23 nt, Artificial Sequence
  source: /note="Description of Artificial Sequence: Synthetic oligonucleotide"
uucacuaggucaaauauacaucc

SEQ ID NO: 3019 - RNA, 23 nt, Artificial Sequence
  source: /note="Description of Artificial Sequence: Synthetic oligonucleotide"
uaguaaaaguguacucgacauuu

SEQ ID NO: 3020 - RNA, 23 nt, Artificial Sequence
  source: /note="Description of Artificial Sequence: Synthetic oligonucleotide"
ucuaaacuuaaagucacaauaag

SEQ ID NO: 3021 - RNA, 23 nt, Artificial Sequence
  source: /note="Description of Artificial Sequence: Synthetic oligonucleotide"
ucaaaucagcuagaaacauaccu

SEQ ID NO: 3022 - RNA, 23 nt, Artificial Sequence
  source: /note="Description of Artificial Sequence: Synthetic oligonucleotide"
uacgaagagaauccaucucccca

SEQ ID NO: 3023 - RNA, 23 nt, Artificial Sequence
  source: /note="Description of Artificial Sequence: Synthetic oligonucleotide"
uaacuaacugcauaucaggaagg

SEQ ID NO: 3024 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uuaauutaggaaaguaaguuggu

SEQ ID NO: 3025 - RNA, 23 nt, Artificial Sequence
  source: /note="Description of Artificial Sequence: Synthetic oligonucleotide"
uagaccaaauuuccuauagcaag

SEQ ID NO: 3026 - RNA, 23 nt, Artificial Sequence
  source: /note="Description of Artificial Sequence: Synthetic oligonucleotide"
uagauuacuuccauaauuuagga

SEQ ID NO: 3027 - RNA, 23 nt, Artificial Sequence
  source: /note="Description of Artificial Sequence: Synthetic oligonucleotide"
ucaauacucuaaagguaagucuu

SEQ ID NO: 3028 - RNA, 23 nt, Artificial Sequence
  source: /note="Description of Artificial Sequence: Synthetic oligonucleotide"
ugagauagguaaccaaguccgac

SEQ ID NO: 3029 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uacgaatgcugaguggugacuga

SEQ ID NO: 3030 - RNA, 23 nt, Artificial Sequence
  source: /note="Description of Artificial Sequence: Synthetic oligonucleotide"
uacuaacauucauaagggcaaaa

SEQ ID NO: 3031 - RNA, 23 nt, Artificial Sequence
  source: /note="Description of Artificial Sequence: Synthetic oligonucleotide"
uaauuacaauccugugaaaagau

SEQ ID NO: 3032 - RNA, 23 nt, Artificial Sequence
  source: /note="Description of Artificial Sequence: Synthetic oligonucleotide"
uucggaauucauagguucagccu

SEQ ID NO: 3033 - RNA, 23 nt, Artificial Sequence
  source: /note="Description of Artificial Sequence: Synthetic oligonucleotide"
ugccuaaacaaggcuaagaaggc

SEQ ID NO: 3034 - RNA, 23 nt, Artificial Sequence
  source: /note="Description of Artificial Sequence: Synthetic oligonucleotide"
uacucuauguuaacuuggcagca

SEQ ID NO: 3035 - RNA, 23 nt, Artificial Sequence
  source: /note="Description of Artificial Sequence: Synthetic oligonucleotide"
uugguaauugcaagaucuacaaa

SEQ ID NO: 3036 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uaaucutgggucauuagccuaaa

SEQ ID NO: 3037 - RNA, 23 nt, Artificial Sequence
  source: /note="Description of Artificial Sequence: Synthetic oligonucleotide"
uaggaaaaucacuacgacaaaga

SEQ ID NO: 3038 - RNA, 23 nt, Artificial Sequence
  source: /note="Description of Artificial Sequence: Synthetic oligonucleotide"
ucucacauaagaggcuugcaacc

SEQ ID NO: 3039 - RNA, 19 nt, Homo sapiens
ucacaaaacagucucuugc

SEQ ID NO: 3040 - RNA, 19 nt, Homo sapiens
ggaaaacaaucuuccguuu

SEQ ID NO: 3041 - RNA, 19 nt, Homo sapiens
gaaaacaaucuuccguuuc

SEQ ID NO: 3042 - RNA, 19 nt, Homo sapiens
aaaacaaucuuccguuuca

SEQ ID NO: 3043 - RNA, 19 nt, Homo sapiens
aaacaaucuuccguuucaa

SEQ ID NO: 3044 - RNA, 19 nt, Homo sapiens
aacaaucuuccguuucaau

SEQ ID NO: 3045 - RNA, 19 nt, Homo sapiens
caaucuuccguuucaaugc

SEQ ID NO: 3046 - RNA, 19 nt, Homo sapiens
ccugcuuuauauaugcuuu

SEQ ID NO: 3047 - RNA, 19 nt, Homo sapiens
cugcuuuauauaugcuuuc

SEQ ID NO: 3048 - RNA, 19 nt, Homo sapiens
uaugcuuucuccuuucagu

SEQ ID NO: 3049 - RNA, 19 nt, Homo sapiens
augcuuucuccuuucaguc

SEQ ID NO: 3050 - RNA, 19 nt, Homo sapiens
ugcuuucuccuuucagucc

SEQ ID NO: 3051 - RNA, 19 nt, Homo sapiens
cuuucuccuuucaguccuc

SEQ ID NO: 3052 - RNA, 19 nt, Homo sapiens
ucuccuuucaguccucuaa

SEQ ID NO: 3053 - RNA, 19 nt, Homo sapiens
cuccuuucaguccucuaag

SEQ ID NO: 3054 - RNA, 19 nt, Homo sapiens
uccuuucaguccucuaaga

SEQ ID NO: 3055 - RNA, 19 nt, Homo sapiens
ccuuucaguccucuaagaa

SEQ ID NO: 3056 - RNA, 19 nt, Homo sapiens
cuuucaguccucuaagaag

SEQ ID NO: 3057 - RNA, 19 nt, Homo sapiens
aguccucuaagaagaauau

SEQ ID NO: 3058 - RNA, 19 nt, Homo sapiens
uccucuaagaagaauaucu

SEQ ID NO: 3059 - RNA, 19 nt, Homo sapiens
ccucuaagaagaauaucua

SEQ ID NO: 3060 - RNA, 19 nt, Homo sapiens
cucuaagaagaauaucuau

SEQ ID NO: 3061 - RNA, 19 nt, Homo sapiens
auuuuaguacacuccuuau

SEQ ID NO: 3062 - RNA, 19 nt, Homo sapiens
uaguacacuccuuauucag

SEQ ID NO: 3063 - RNA, 19 nt, Homo sapiens
aguacacuccuuauucagc

SEQ ID NO: 3064 - RNA, 19 nt, Homo sapiens
ccuuauucagcaugcucau

SEQ ID NO: 3065 - RNA, 19 nt, Homo sapiens
ucaucaugugcacuauucu

SEQ ID NO: 3066 - RNA, 19 nt, Homo sapiens
caucaugugcacuauucug

SEQ ID NO: 3067 - RNA, 19 nt, Homo sapiens
ugucgaguacacuuuuacu

SEQ ID NO: 3068 - RNA, 19 nt, Homo sapiens
gucgaguacacuuuuacug

SEQ ID NO: 3069 - RNA, 19 nt, Homo sapiens
cuucuguguaggagaauuc

SEQ ID NO: 3070 - RNA, 19 nt, Homo sapiens
uaggagaauucacuuuucu

SEQ ID NO: 3071 - RNA, 19 nt, Homo sapiens
aggagaauucacuuuucuu

SEQ ID NO: 3072 - RNA, 19 nt, Homo sapiens
ggagaauucacuuuucuuc

SEQ ID NO: 3073 - RNA, 19 nt, Homo sapiens
ggcaauguuucagcucuuc

SEQ ID NO: 3074 - RNA, 19 nt, Homo sapiens
aauguuucagcucuucgaa

SEQ ID NO: 3075 - RNA, 19 nt, Homo sapiens
guuucagcucuucgaacuu

SEQ ID NO: 3076 - RNA, 19 nt, Homo sapiens
ucagcucuucgaacuuuca

SEQ ID NO: 3077 - RNA, 19 nt, Homo sapiens
agcucuucgaacuuucaga

SEQ ID NO: 3078 - RNA, 19 nt, Homo sapiens
cucuucgaacuuucagagu

SEQ ID NO: 3079 - RNA, 19 nt, Homo sapiens
cuucgaacuuucagaguau

SEQ ID NO: 3080 - RNA, 19 nt, Homo sapiens
uccugacuguguucugucu

SEQ ID NO: 3081 - RNA, 19 nt, Homo sapiens
cugacuguguucugucuga

SEQ ID NO: 3082 - RNA, 19 nt, Homo sapiens
ugacuguguucugucugag

SEQ ID NO: 3083 - RNA, 19 nt, Homo sapiens
gacuguguucugucugagu

SEQ ID NO: 3084 - RNA, 19 nt, Homo sapiens
acuguguucugucugagug

SEQ ID NO: 3085 - RNA, 19 nt, Homo sapiens
cuguguucugucugagugu

SEQ ID NO: 3086 - RNA, 19 nt, Homo sapiens
uguguucugucugagugug

SEQ ID NO: 3087 - RNA, 19 nt, Homo sapiens
uguucugucugaguguguu

SEQ ID NO: 3088 - RNA, 19 nt, Homo sapiens
guucugucugaguguguuu

SEQ ID NO: 3089 - RNA, 19 nt, Homo sapiens
uucugucugaguguguuug

SEQ ID NO: 3090 - RNA, 19 nt, Homo sapiens
ucugucugaguguguuugc

SEQ ID NO: 3091 - RNA, 19 nt, Homo sapiens
ugcucuccuuugugguuuc

SEQ ID NO: 3092 - RNA, 19 nt, Homo sapiens
cucuccuuugugguuucag

SEQ ID NO: 3093 - RNA, 19 nt, Homo sapiens
ucuccuuugugguuucagc

SEQ ID NO: 3094 - RNA, 19 nt, Homo sapiens
cuccuuugugguuucagca

SEQ ID NO: 3095 - RNA, 19 nt, Homo sapiens
cgagcuuugacacuuucag

SEQ ID NO: 3096 - RNA, 19 nt, Homo sapiens
acaugaucuucuuugucgu

SEQ ID NO: 3097 - RNA, 19 nt, Homo sapiens
caugaucuucuuugucgua

SEQ ID NO: 3098 - RNA, 19 nt, Homo sapiens
gaucuucuuugucguagug

SEQ ID NO: 3099 - RNA, 19 nt, Homo sapiens
ucuucuuugucguagugau

SEQ ID NO: 3100 - RNA, 19 nt, Homo sapiens
cuucuuugucguagugauu

SEQ ID NO: 3101 - RNA, 19 nt, Homo sapiens
uugucguagugauuuuccu

SEQ ID NO: 3102 - RNA, 19 nt, Homo sapiens
gcuccuuuuaucuaauaaa

SEQ ID NO: 3103 - RNA, 19 nt, Homo sapiens
cuccuuuuaucuaauaaac

SEQ ID NO: 3104 - RNA, 19 nt, Homo sapiens
ccucucagagaguucuucu

SEQ ID NO: 3105 - RNA, 19 nt, Homo sapiens
cucucagagaguucuucug

SEQ ID NO: 3106 - RNA, 19 nt, Homo sapiens
ucucagagaguucuucuga

SEQ ID NO: 3107 - RNA, 19 nt, Homo sapiens
cucagagaguucuucugaa

SEQ ID NO: 3108 - RNA, 19 nt, Homo sapiens
ucagagaguucuucugaaa

SEQ ID NO: 3109 - RNA, 19 nt, Homo sapiens
cagagaguucuucugaaac

SEQ ID NO: 3110 - RNA, 19 nt, Homo sapiens
gagaguucuucugaaacau

SEQ ID NO: 3111 - RNA, 19 nt, Homo sapiens
agaguucuucugaaacauc

SEQ ID NO: 3112 - RNA, 19 nt, Homo sapiens
gaguucuucugaaacaucc

SEQ ID NO: 3113 - RNA, 19 nt, Homo sapiens
aguucuucugaaacaucca

SEQ ID NO: 3114 - RNA, 19 nt, Homo sapiens
guucuucugaaacauccaa

SEQ ID NO: 3115 - RNA, 19 nt, Homo sapiens
ucuucugaaacauccaaac

SEQ ID NO: 3116 - RNA, 19 nt, Homo sapiens
cuucugaaacauccaaacu

SEQ ID NO: 3117 - RNA, 19 nt, Homo sapiens
ucugaaacauccaaacuga

SEQ ID NO: 3118 - RNA, 19 nt, Homo sapiens
uccaaacugagcucuaaaa

SEQ ID NO: 3119 - RNA, 19 nt, Homo sapiens
aggcguuguaguuccuauc

SEQ ID NO: 3120 - RNA, 19 nt, Homo sapiens
gcguuguaguuccuaucuc

SEQ ID NO: 3121 - RNA, 19 nt, Homo sapiens
cguuguaguuccuaucucc

SEQ ID NO: 3122 - RNA, 19 nt, Homo sapiens
guuguaguuccuaucuccu

SEQ ID NO: 3123 - RNA, 19 nt, Homo sapiens
uuguaguuccuaucuccuu

SEQ ID NO: 3124 - RNA, 19 nt, Homo sapiens
uguaguuccuaucuccuuu

SEQ ID NO: 3125 - RNA, 19 nt, Homo sapiens
guaguuccuaucuccuuuc

SEQ ID NO: 3126 - RNA, 19 nt, Homo sapiens
uaguuccuaucuccuuuca

SEQ ID NO: 3127 - RNA, 19 nt, Homo sapiens
aguuccuaucuccuuucag

SEQ ID NO: 3128 - RNA, 19 nt, Homo sapiens
guuccuaucuccuuucaga

SEQ ID NO: 3129 - RNA, 19 nt, Homo sapiens
uuccuaucuccuuucagag

SEQ ID NO: 3130 - RNA, 19 nt, Homo sapiens
uccuaucuccuuucagagg

SEQ ID NO: 3131 - RNA, 19 nt, Homo sapiens
ucuccuuucagaggauaug

SEQ ID NO: 3132 - RNA, 19 nt, Homo sapiens
gcauauuaacaaacacugu

SEQ ID NO: 3133 - RNA, 19 nt, Homo sapiens
cuugaucuggaauugcucu

SEQ ID NO: 3134 - RNA, 19 nt, Homo sapiens
cucuccauauuggauaaaa

SEQ ID NO: 3135 - RNA, 19 nt, Homo sapiens
ucuccauauuggauaaaau

SEQ ID NO: 3136 - RNA, 19 nt, Homo sapiens
cuccauauuggauaaaauu

SEQ ID NO: 3137 - RNA, 19 nt, Homo sapiens
gaucuugcaauuaccauuu

SEQ ID NO: 3138 - RNA, 19 nt, Homo sapiens
uuggucuuuacuggaaucu

SEQ ID NO: 3139 - RNA, 19 nt, Homo sapiens
ggucuuuacuggaaucuuu

SEQ ID NO: 3140 - RNA, 19 nt, Homo sapiens
gucuuuacuggaaucuuug

SEQ ID NO: 3141 - RNA, 19 nt, Homo sapiens
gccuuauugugacuuuaag

SEQ ID NO: 3142 - RNA, 19 nt, Homo sapiens
gcucuuucuagcagaugug

SEQ ID NO: 3143 - RNA, 19 nt, Homo sapiens
cucuuucuagcagaugugg

SEQ ID NO: 3144 - RNA, 19 nt, Homo sapiens
gucaguucugcgaucauuc

SEQ ID NO: 3145 - RNA, 19 nt, Homo sapiens
ucaguucugcgaucauuca

SEQ ID NO: 3146 - RNA, 19 nt, Homo sapiens
agucuucaaguuggcaaaa

SEQ ID NO: 3147 - RNA, 19 nt, Homo sapiens
ucuucaaguuggcaaaauc

SEQ ID NO: 3148 - RNA, 19 nt, Homo sapiens
cuucaaguuggcaaaaucc

SEQ ID NO: 3149 - RNA, 19 nt, Homo sapiens
ccaucaucgucuucauuuu

SEQ ID NO: 3150 - RNA, 19 nt, Homo sapiens
caucaucgucuucauuuuu

SEQ ID NO: 3151 - RNA, 19 nt, Homo sapiens
gcacaugaacgacuucuuc

SEQ ID NO: 3152 - RNA, 19 nt, Homo sapiens
cacaugaacgacuucuucc

SEQ ID NO: 3153 - RNA, 19 nt, Homo sapiens
acaugaacgacuucuucca

SEQ ID NO: 3154 - RNA, 19 nt, Homo sapiens
caugaacgacuucuuccac

SEQ ID NO: 3155 - RNA, 19 nt, Homo sapiens
ugaacgacuucuuccacuc

SEQ ID NO: 3156 - RNA, 19 nt, Homo sapiens
cgacuucuuccacuccuuc

SEQ ID NO: 3157 - RNA, 19 nt, Homo sapiens
uccacuccuuccugauugu

SEQ ID NO: 3158 - RNA, 19 nt, Homo sapiens
acuccuuccugauuguguu

SEQ ID NO: 3159 - RNA, 19 nt, Homo sapiens
cuccuuccugauuguguuc

SEQ ID NO: 3160 - RNA, 19 nt, Homo sapiens
uccuuccugauuguguucc

SEQ ID NO: 3161 - RNA, 19 nt, Homo sapiens
cuaugugccuuauuguuua

SEQ ID NO: 3162 - RNA, 19 nt, Homo sapiens
ugguccuaaaccuauuucu

SEQ ID NO: 3163 - RNA, 19 nt, Homo sapiens
gguccuaaaccuauuucug

SEQ ID NO: 3164 - RNA, 19 nt, Homo sapiens
guccuaaaccuauuucugg

SEQ ID NO: 3165 - RNA, 19 nt, Homo sapiens
ccuuacgugaauuuauucu

SEQ ID NO: 3166 - RNA, 19 nt, Homo sapiens
caaaggucacaauuuccuc

SEQ ID NO: 3167 - RNA, 19 nt, Homo sapiens
ucacaauuuccucaaggaa

SEQ ID NO: 3168 - RNA, 19 nt, Homo sapiens
ccucaaggaaaaagauaaa

SEQ ID NO: 3169 - RNA, 19 nt, Homo sapiens
gcuucauuguccucaugau

SEQ ID NO: 3170 - RNA, 19 nt, Homo sapiens
cuucauuguccucaugauc

SEQ ID NO: 3171 - RNA, 19 nt, Homo sapiens
ugcagacaagaucuucacu

SEQ ID NO: 3172 - RNA, 19 nt, Homo sapiens
cagacaagaucuucacuua

SEQ ID NO: 3173 - RNA, 19 nt, Homo sapiens
agacaagaucuucacuuac

SEQ ID NO: 3174 - RNA, 19 nt, Homo sapiens
gacaagaucuucacuuaca

SEQ ID NO: 3175 - RNA, 19 nt, Homo sapiens
acaagaucuucacuuacau

SEQ ID NO: 3176 - RNA, 19 nt, Homo sapiens
caagaucuucacuuacauc

SEQ ID NO: 3177 - RNA, 19 nt, Homo sapiens
agaucuucacuuacaucuu

SEQ ID NO: 3178 - RNA, 19 nt, Homo sapiens
gaucuucacuuacaucuuc

SEQ ID NO: 3179 - RNA, 19 nt, Homo sapiens
ucuucacuuacaucuucau

SEQ ID NO: 3180 - RNA, 19 nt, Homo sapiens
cuucacuuacaucuucauu

SEQ ID NO: 3181 - RNA, 19 nt, Homo sapiens
uucacuuacaucuucauuc

SEQ ID NO: 3182 - RNA, 19 nt, Homo sapiens
ucacuuacaucuucauucu

SEQ ID NO: 3183 - RNA, 19 nt, Homo sapiens
cacuuacaucuucauucug

SEQ ID NO: 3184 - RNA, 19 nt, Homo sapiens
cuuacaucuucauucugga

SEQ ID NO: 3185 - RNA, 19 nt, Homo sapiens
acaucuucauucuggaaau

SEQ ID NO: 3186 - RNA, 19 nt, Homo sapiens
caucuucauucuggaaaug

SEQ ID NO: 3187 - RNA, 19 nt, Homo sapiens
ucuucauucuggaaaugcu

SEQ ID NO: 3188 - RNA, 19 nt, Homo sapiens
cuucauucuggaaaugcuu

SEQ ID NO: 3189 - RNA, 19 nt, Homo sapiens
ucuggaaaugcuucuaaaa

SEQ ID NO: 3190 - RNA, 19 nt, Homo sapiens
gcuggauuuccuaauuguu

SEQ ID NO: 3191 - RNA, 19 nt, Homo sapiens
cuggauuuccuaauuguug

SEQ ID NO: 3192 - RNA, 19 nt, Homo sapiens
ccucuaagagccuuaucua

SEQ ID NO: 3193 - RNA, 19 nt, Homo sapiens
cucuaagagccuuaucuag

SEQ ID NO: 3194 - RNA, 19 nt, Homo sapiens
cuuccaucaugaaugugcu

SEQ ID NO: 3195 - RNA, 19 nt, Homo sapiens
uuuccugcaagucaaguuc

SEQ ID NO: 3196 - RNA, 19 nt, Homo sapiens
cugcaagucaaguuccaaa

SEQ ID NO: 3197 - RNA, 19 nt, Homo sapiens
agucaaguuccaaaucguu

SEQ ID NO: 3198 - RNA, 19 nt, Homo sapiens
acuugguuaccuaucucug

SEQ ID NO: 3199 - RNA, 19 nt, Homo sapiens
cuugguuaccuaucucugc

SEQ ID NO: 3200 - RNA, 19 nt, Homo sapiens
gguuaccuaucucugcuuc

SEQ ID NO: 3201 - RNA, 19 nt, Homo sapiens
guuaccuaucucugcuuca

SEQ ID NO: 3202 - RNA, 19 nt, Homo sapiens
uuaccuaucucugcuucaa

SEQ ID NO: 3203 - RNA, 19 nt, Homo sapiens
uaccuaucucugcuucaag

SEQ ID NO: 3204 - RNA, 19 nt, Homo sapiens
accuaucucugcuucaagu

SEQ ID NO: 3205 - RNA, 19 nt, Homo sapiens
ccuaucucugcuucaaguu

SEQ ID NO: 3206 - RNA, 19 nt, Homo sapiens
cuaucucugcuucaaguug

SEQ ID NO: 3207 - RNA, 19 nt, Homo sapiens
aucucugcuucaaguugca

SEQ ID NO: 3208 - RNA, 19 nt, Homo sapiens
ucucugcuucaaguugcaa

SEQ ID NO: 3209 - RNA, 19 nt, Homo sapiens
cucugcuucaaguugcaac

SEQ ID NO: 3210 - RNA, 19 nt, Homo sapiens
ucugcuucaaguugcaacu

SEQ ID NO: 3211 - RNA, 19 nt, Homo sapiens
uaucaucuuugggucauuc

SEQ ID NO: 3212 - RNA, 19 nt, Homo sapiens
aucaucuuugggucauucu

SEQ ID NO: 3213 - RNA, 19 nt, Homo sapiens
ucaucuuugggucauucuu

SEQ ID NO: 3214 - RNA, 19 nt, Homo sapiens
caucuuugggucauucuuc

SEQ ID NO: 3215 - RNA, 19 nt, Homo sapiens
cuuugggucauucuucacu

SEQ ID NO: 3216 - RNA, 19 nt, Homo sapiens
uugggucauucuucacuuu

SEQ ID NO: 3217 - RNA, 19 nt, Homo sapiens
ugggucauucuucacuuug

SEQ ID NO: 3218 - RNA, 19 nt, Homo sapiens
gggucauucuucacuuuga

SEQ ID NO: 3219 - RNA, 19 nt, Homo sapiens
ggucauucuucacuuugaa

SEQ ID NO: 3220 - RNA, 19 nt, Homo sapiens
gucauucuucacuuugaac

SEQ ID NO: 3221 - RNA, 19 nt, Homo sapiens
cauucuucacuuugaacuu

SEQ ID NO: 3222 - RNA, 19 nt, Homo sapiens
ucacuuugaacuuguucau

SEQ ID NO: 3223 - RNA, 19 nt, Homo sapiens
cuuguucauuggugucauc

SEQ ID NO: 3224 - RNA, 19 nt, Homo sapiens
gugucaucauagauaauuu

SEQ ID NO: 3225 - RNA, 19 nt, Homo sapiens
ugucaucauagauaauuuc

SEQ ID NO: 3226 - RNA, 19 nt, Homo sapiens
gaggucaagacaucuuuau

SEQ ID NO: 3227 - RNA, 19 nt, Homo sapiens
aggucaagacaucuuuaug

SEQ ID NO: 3228 - RNA, 19 nt, Homo sapiens
ggucaagacaucuuuauga

SEQ ID NO: 3229 - RNA, 19 nt, Homo sapiens
ccacaaaagccaauuccuc

SEQ ID NO: 3230 - RNA, 19 nt, Homo sapiens
gaccuagugacaaaucaag

SEQ ID NO: 3231 - RNA, 19 nt, Homo sapiens
guaucaugguucuuaucug

SEQ ID NO: 3232 - RNA, 19 nt, Homo sapiens
uaucaugguucuuaucugu

SEQ ID NO: 3233 - RNA, 19 nt, Homo sapiens
ucaugguucuuaucugucu

SEQ ID NO: 3234 - RNA, 19 nt, Homo sapiens
caugguucuuaucugucuc

SEQ ID NO: 3235 - RNA, 19 nt, Homo sapiens
augguucuuaucugucuca

SEQ ID NO: 3236 - RNA, 19 nt, Homo sapiens
ugguucuuaucugucucaa

SEQ ID NO: 3237 - RNA, 19 nt, Homo sapiens
gguucuuaucugucucaac

SEQ ID NO: 3238 - RNA, 19 nt, Homo sapiens
guucuuaucugucucaaca

SEQ ID NO: 3239 - RNA, 19 nt, Homo sapiens
ucuuaucugucucaacaug

SEQ ID NO: 3240 - RNA, 19 nt, Homo sapiens
aucugucucaacaugguaa

SEQ ID NO: 3241 - RNA, 19 nt, Homo sapiens
ucugucucaacaugguaac

SEQ ID NO: 3242 - RNA, 19 nt, Homo sapiens
cugucucaacaugguaacc

SEQ ID NO: 3243 - RNA, 19 nt, Homo sapiens
uccuggucauguucaucua

SEQ ID NO: 3244 - RNA, 19 nt, Homo sapiens
aguucauccuggaaguuca

SEQ ID NO: 3245 - RNA, 19 nt, Homo sapiens
ccaucuguuggaauauucu

SEQ ID NO: 3246 - RNA, 19 nt, Homo sapiens
caucuguuggaauauucua

SEQ ID NO: 3247 - RNA, 19 nt, Homo sapiens
ucuguuggaauauucuacu

SEQ ID NO: 3248 - RNA, 19 nt, Homo sapiens
cauacuggagaauuuuagu

SEQ ID NO: 3249 - RNA, 19 nt, Homo sapiens
cuccucuucucauagcaaa

SEQ ID NO: 3250 - RNA, 19 nt, Homo sapiens
uccucuucucauagcaaaa

SEQ ID NO: 3251 - RNA, 19 nt, Homo sapiens
ccucuucucauagcaaaac

SEQ ID NO: 3252 - RNA, 19 nt, Homo sapiens
cucuucucauagcaaaacc

SEQ ID NO: 3253 - RNA, 19 nt, Homo sapiens
gauccauugucuugacauc

SEQ ID NO: 3254 - RNA, 19 nt, Homo sapiens
auccauugucuugacaucu

SEQ ID NO: 3255 - RNA, 19 nt, Homo sapiens
uccauugucuugacaucuu

SEQ ID NO: 3256 - RNA, 19 nt, Homo sapiens
cauugucuugacaucuuau

SEQ ID NO: 3257 - RNA, 19 nt, Homo sapiens
uugucuugacaucuuauuu

SEQ ID NO: 3258 - RNA, 19 nt, Homo sapiens
ugucuugacaucuuauuug

SEQ ID NO: 3259 - RNA, 19 nt, Homo sapiens
gucuugacaucuuauuugc

SEQ ID NO: 3260 - RNA, 19 nt, Homo sapiens
ggagauggauucucuucgu

SEQ ID NO: 3261 - RNA, 19 nt, Homo sapiens
gagauggauucucuucguu

SEQ ID NO: 3262 - RNA, 19 nt, Homo sapiens
agauggauucucuucguuc

SEQ ID NO: 3263 - RNA, 19 nt, Homo sapiens
gauggauucucuucguuca

SEQ ID NO: 3264 - RNA, 19 nt, Homo sapiens
auggauucucuucguucac

SEQ ID NO: 3265 - RNA, 19 nt, Homo sapiens
uggauucucuucguucaca

SEQ ID NO: 3266 - RNA, 19 nt, Homo sapiens
ggauucucuucguucacag

SEQ ID NO: 3267 - RNA, 19 nt, Homo sapiens
gauucucuucguucacaga

SEQ ID NO: 3268 - RNA, 19 nt, Homo sapiens
uucucuucguucacagaug

SEQ ID NO: 3269 - RNA, 19 nt, Homo sapiens
ucucuucguucacagaugg

SEQ ID NO: 3270 - RNA, 19 nt, Homo sapiens
cucuucguucacagaugga

SEQ ID NO: 3271 - RNA, 19 nt, Homo sapiens
ucuucguucacagauggaa

SEQ ID NO: 3272 - RNA, 19 nt, Homo sapiens
agguucaugucugcaaauc

SEQ ID NO: 3273 - RNA, 19 nt, Homo sapiens
ucugcaaauccuuccaaag

SEQ ID NO: 3274 - RNA, 19 nt, Homo sapiens
cugcaaauccuuccaaagu

SEQ ID NO: 3275 - RNA, 19 nt, Homo sapiens
gugucugcuacugucauuc

SEQ ID NO: 3276 - RNA, 19 nt, Homo sapiens
ugucugcuacugucauuca

SEQ ID NO: 3277 - RNA, 19 nt, Homo sapiens
gucugcuacugucauucag

SEQ ID NO: 3278 - RNA, 19 nt, Homo sapiens
accgcuuaaggcaaaaugu

SEQ ID NO: 3279 - RNA, 19 nt, Homo sapiens
ccgcuuaaggcaaaauguc

SEQ ID NO: 3280 - RNA, 19 nt, Homo sapiens
ucuccaccuucauaugaua

SEQ ID NO: 3281 - RNA, 19 nt, Homo sapiens
ugccaaaauccuuuuuauc

SEQ ID NO: 3282 - RNA, 19 nt, Homo sapiens
gccaaaauccuuuuuauca

SEQ ID NO: 3283 - RNA, 19 nt, Homo sapiens
ucguaagagaacucuguag

SEQ ID NO: 3284 - RNA, 19 nt, Homo sapiens
ucugccuugucaucuuuuc

SEQ ID NO: 3285 - RNA, 19 nt, Homo sapiens
cugccuugucaucuuuuca

SEQ ID NO: 3286 - RNA, 19 nt, Homo sapiens
ugccuugucaucuuuucac

SEQ ID NO: 3287 - RNA, 19 nt, Homo sapiens
gccuugucaucuuuucaca

SEQ ID NO: 3288 - RNA, 19 nt, Homo sapiens
ccuugucaucuuuucacag

SEQ ID NO: 3289 - RNA, 19 nt, Homo sapiens
caucuuuucacaggauugu

SEQ ID NO: 3290 - RNA, 19 nt, Homo sapiens
cccauguaaauaaacaaca

SEQ ID NO: 3291 - RNA, 19 nt, Homo sapiens
cauucaucuugacucacau

SEQ ID NO: 3292 - RNA, 19 nt, Homo sapiens
acauauuacacuccucaaa

SEQ ID NO: 3293 - RNA, 19 nt, Homo sapiens
cauauuacacuccucaaaa

SEQ ID NO: 3294 - RNA, 19 nt, Homo sapiens
ugcccaaaauacugauaau

SEQ ID NO: 3295 - RNA, 19 nt, Homo sapiens
gcccaaaauacugauaaua

SEQ ID NO: 3296 - RNA, 19 nt, Homo sapiens
cugauaauagucucuuaaa

SEQ ID NO: 3297 - RNA, 19 nt, Homo sapiens
gucaaauuuuccugcuuuc

SEQ ID NO: 3298 - RNA, 19 nt, Homo sapiens
ucaaauuuuccugcuuucu

SEQ ID NO: 3299 - RNA, 19 nt, Homo sapiens
caaauuuuccugcuuucuu

SEQ ID NO: 3300 - RNA, 19 nt, Homo sapiens
auuguuuagucauccuuuc

SEQ ID NO: 3301 - RNA, 19 nt, Homo sapiens
gcaucacuuguauacaauc

SEQ ID NO: 3302 - RNA, 19 nt, Homo sapiens
caccaacuuacuuuccuaa

SEQ ID NO: 3303 - RNA, 19 nt, Homo sapiens
accaacuuacuuuccuaaa

SEQ ID NO: 3304 - RNA, 19 nt, Homo sapiens
ccaacuuacuuuccuaaau

SEQ ID NO: 3305 - RNA, 19 nt, Homo sapiens
caacuuacuuuccuaaauu

SEQ ID NO: 3306 - RNA, 19 nt, Homo sapiens
aggaagaugucaccuucuc

SEQ ID NO: 3307 - RNA, 19 nt, Homo sapiens
gaagaugucaccuucuccu

SEQ ID NO: 3308 - RNA, 19 nt, Homo sapiens
agaugucaccuucuccuua

SEQ ID NO: 3309 - RNA, 19 nt, Homo sapiens
gaugucaccuucuccuuaa

SEQ ID NO: 3310 - RNA, 19 nt, Homo sapiens
augucaccuucuccuuaaa

SEQ ID NO: 3311 - RNA, 19 nt, Homo sapiens
ugucaccuucuccuuaaaa

SEQ ID NO: 3312 - RNA, 19 nt, Homo sapiens
gucaccuucuccuuaaaau

SEQ ID NO: 3313 - RNA, 19 nt, Homo sapiens
ucaccuucuccuuaaaauu

SEQ ID NO: 3314 - RNA, 19 nt, Homo sapiens
accuucuccuuaaaauucu

SEQ ID NO: 3315 - RNA, 19 nt, Homo sapiens
ccuucuccuuaaaauucua

SEQ ID NO: 3316 - RNA, 19 nt, Homo sapiens
cuucuccuuaaaauucuau

SEQ ID NO: 3317 - RNA, 19 nt, Homo sapiens
ugagaucuuucuucuauaa

SEQ ID NO: 3318 - RNA, 19 nt, Homo sapiens
gaucuuucuucuauaaagu

SEQ ID NO: 3319 - RNA, 19 nt, Homo sapiens
uaccaucuuagguucauuc

SEQ ID NO: 3320 - RNA, 19 nt, Homo sapiens
accaucuuagguucauuca

SEQ ID NO: 3321 - RNA, 19 nt, Homo sapiens
ccaucuuagguucauucau

SEQ ID NO: 3322 - RNA, 19 nt, Homo sapiens
caucuuagguucauucauc

SEQ ID NO: 3323 - RNA, 19 nt, Homo sapiens
ucuuagguucauucaucuu

SEQ ID NO: 3324 - RNA, 19 nt, Homo sapiens
cuuagguucauucaucuua

SEQ ID NO: 3325 - RNA, 19 nt, Homo sapiens
uuagguucauucaucuuag

SEQ ID NO: 3326 - RNA, 19 nt, Homo sapiens
uagguucauucaucuuagg

SEQ ID NO: 3327 - RNA, 19 nt, Homo sapiens
cugcauuaugaauacuuac

SEQ ID NO: 3328 - RNA, 19 nt, Homo sapiens
acacaauuucuucuuagca

SEQ ID NO: 3329 - RNA, 19 nt, Homo sapiens
guucuuuuuccuauuucau

SEQ ID NO: 3330 - RNA, 19 nt, Homo sapiens
uccuauuucaugaacuaug

SEQ ID NO: 3331 - RNA, 19 nt, Homo sapiens
ccuauuucaugaacuaugu

SEQ ID NO: 3332 - RNA, 19 nt, Homo sapiens
augucuacuugugacuuuu

SEQ ID NO: 3333 - RNA, 19 nt, Homo sapiens
ugucuacuugugacuuuuu

SEQ ID NO: 3334 - RNA, 19 nt, Homo sapiens
ucuacuugugacuuuuuau

SEQ ID NO: 3335 - RNA, 19 nt, Homo sapiens
cuacuugugacuuuuuauc

SEQ ID NO: 3336 - RNA, 19 nt, Homo sapiens
guucuaaauagcuauuuca

SEQ ID NO: 3337 - RNA, 19 nt, Homo sapiens
gcuguuuacauaggauucu

SEQ ID NO: 3338 - RNA, 19 nt, Homo sapiens
gcucaaaauguuugaguuu

SEQ ID NO: 3339 - RNA, 23 nt, Homo sapiens
cuuuuguagaucuugcaauuacc

SEQ ID NO: 3340 - RNA, 23 nt, Homo sapiens
gcuucuguguaggagaauucacu

SEQ ID NO: 3341 - RNA, 23 nt, Homo sapiens
uuaugugaaacaaaccuuacgug

SEQ ID NO: 3342 - RNA, 23 nt, Homo sapiens
uguguaggagaauucacuuuucu

SEQ ID NO: 3343 - RNA, 23 nt, Homo sapiens
auuaugugaaacaaaccuuacgu

SEQ ID NO: 3344 - RNA, 23 nt, Homo sapiens
gaagcauaaauguuuucgaaauu

SEQ ID NO: 3345 - RNA, 23 nt, Homo sapiens
augaucuucuuugucguagugau

SEQ ID NO: 3346 - RNA, 23 nt, Homo sapiens
aaggcguuguaguuccuaucucc

SEQ ID NO: 3347 - RNA, 23 nt, Homo sapiens
ugaucuucuuugucguagugauu

SEQ ID NO: 3348 - RNA, 23 nt, Homo sapiens
ugugguuucagcacagauucagg

SEQ ID NO: 3349 - RNA, 23 nt, Homo sapiens
aaugucgaguacacuuuuacugg

SEQ ID NO: 3350 - RNA, 23 nt, Homo sapiens
acaagcagaagaucugaauacua

SEQ ID NO: 3351 - RNA, 23 nt, Homo sapiens
uucaaguguuccuacugucauga

SEQ ID NO: 3352 - RNA, 23 nt, Homo sapiens
agaugcugagaaauugucgaaau

SEQ ID NO: 3353 - RNA, 23 nt, Homo sapiens
guauguuucuagcugauuugauu

SEQ ID NO: 3354 - RNA, 23 nt, Homo sapiens
gggagauggauucucuucguuca

SEQ ID NO: 3355 - RNA, 23 nt, Homo sapiens
uauugugacuuuaaguuuagugg

SEQ ID NO: 3356 - RNA, 23 nt, Homo sapiens
acaugaucuucuuugucguagug

SEQ ID NO: 3357 - RNA, 23 nt, Homo sapiens
caaagggaaaacaaucuuccguu

SEQ ID NO: 3358 - RNA, 23 nt, Homo sapiens
uucuucugaaacauccaaacuga

SEQ ID NO: 3359 - RNA, 23 nt, Homo sapiens
acuugcuauaggaaauuuggucu

SEQ ID NO: 3360 - RNA, 23 nt, Homo sapiens
cuuauugugacuuuaaguuuagu

SEQ ID NO: 3361 - RNA, 23 nt, Homo sapiens
aauuggcagaaacccugauuaug

SEQ ID NO: 3362 - RNA, 23 nt, Homo sapiens
cuacaugaucuucuuugucguag

SEQ ID NO: 3363 - RNA, 23 nt, Homo sapiens
uaagcuugaaguaaaauuagacc

SEQ ID NO: 3364 - RNA, 23 nt, Homo sapiens
guuccaaaucguuccgaauguuu

SEQ ID NO: 3365 - RNA, 23 nt, Homo sapiens
ggaucugagacugaauuugccga

SEQ ID NO: 3366 - RNA, 23 nt, Homo sapiens
aggcguuguaguuccuaucuccu

SEQ ID NO: 3367 - RNA, 23 nt, Homo sapiens
gauauauuuuacaacauccguua

SEQ ID NO: 3368 - RNA, 23 nt, Homo sapiens
aaaugucgaguacacuuuuacug

SEQ ID NO: 3369 - RNA, 23 nt, Homo sapiens
uuugauaguuaccuaguuugcaa

SEQ ID NO: 3370 - RNA, 23 nt, Homo sapiens
aagacuuaccuuuagaguauugu

SEQ ID NO: 3371 - RNA, 23 nt, Homo sapiens
uccuaaauuauggaaguaaucuu

SEQ ID NO: 3372 - RNA, 23 nt, Homo sapiens
caagucaaguuccaaaucguucc

SEQ ID NO: 3373 - RNA, 23 nt, Homo sapiens
caugaucuucuuugucguaguga

SEQ ID NO: 3374 - RNA, 23 nt, Homo sapiens
agguuugaacacaaaucuuucgg

SEQ ID NO: 3375 - RNA, 23 nt, Homo sapiens
ucaaguuccaaaucguuccgaau

SEQ ID NO: 3376 - RNA, 23 nt, Homo sapiens
uuuguagaucuugcaauuaccau

SEQ ID NO: 3377 - RNA, 23 nt, Homo sapiens
uacaugaucuucuuugucguagu

SEQ ID NO: 3378 - RNA, 23 nt, Homo sapiens
uuuugauaguuaccuaguuugca

SEQ ID NO: 3379 - RNA, 23 nt, Homo sapiens
gucaccuucuccuuaaaauucua

SEQ ID NO: 3380 - RNA, 23 nt, Homo sapiens
cucugauuuccuaagaaaggugg

SEQ ID NO: 3381 - RNA, 23 nt, Homo sapiens
cuugagacugacacauuguaaua

SEQ ID NO: 3382 - RNA, 23 nt, Homo sapiens
ggcugaauauacaaguauuagga

SEQ ID NO: 3383 - RNA, 23 nt, Homo sapiens
cacaacccaaaauacuuagcaug

SEQ ID NO: 3384 - RNA, 23 nt, Homo sapiens
uacugauaauagucucuuaaacu

SEQ ID NO: 3385 - RNA, 23 nt, Homo sapiens
ucuuugucguagugauuuuccug

SEQ ID NO: 3386 - RNA, 23 nt, Homo sapiens
gcugaauauacaaguauuaggag

SEQ ID NO: 3387 - RNA, 23 nt, Homo sapiens
ggagauggauucucuucguucac

SEQ ID NO: 3388 - RNA, 23 nt, Homo sapiens
ugaauaucauaaagcuguuuaca

SEQ ID NO: 3389 - RNA, 23 nt, Homo sapiens
auucuuuauaccaucuuagguuc

SEQ ID NO: 3390 - RNA, 23 nt, Homo sapiens
gagcaaaggucacaauuuccuca

SEQ ID NO: 3391 - RNA, 23 nt, Homo sapiens
ucagucaccacucagcauucgug

SEQ ID NO: 3392 - RNA, 23 nt, Homo sapiens
cuugcuauaggaaauuuggucuu

SEQ ID NO: 3393 - RNA, 23 nt, Homo sapiens
gagacagagaugaugauuuacuc

SEQ ID NO: 3394 - RNA, 23 nt, Homo sapiens
gcaagucaaguuccaaaucguuc

SEQ ID NO: 3395 - RNA, 23 nt, Homo sapiens
uuuaggcuaaugacccaagauua

SEQ ID NO: 3396 - RNA, 23 nt, Homo sapiens
gaaagagcuuauuaaguauaagc

SEQ ID NO: 3397 - RNA, 23 nt, Homo sapiens
guuggaauauucuacuuuguuag

SEQ ID NO: 3398 - RNA, 23 nt, Homo sapiens
caauguacagagguuauucuaua

SEQ ID NO: 3399 - RNA, 23 nt, Homo sapiens
gaaucguaagagaacucuguagg

SEQ ID NO: 3400 - RNA, 23 nt, Homo sapiens
cccaucuguuggaauauucuacu

SEQ ID NO: 3401 - RNA, 23 nt, Homo sapiens
uggucuuuacuggaaucuuugca

SEQ ID NO: 3402 - RNA, 23 nt, Homo sapiens
aacaacacaauuucuucuuagca

SEQ ID NO: 3403 - RNA, 23 nt, Homo sapiens
gauggauucucuucguucacaga

SEQ ID NO: 3404 - RNA, 23 nt, Homo sapiens
agguauguuucuagcugauuuga

SEQ ID NO: 3405 - RNA, 23 nt, Homo sapiens
auccuuccugauaugcaguuagu

SEQ ID NO: 3406 - RNA, 23 nt, Homo sapiens
ggggagauggauucucuucguuc

SEQ ID NO: 3407 - RNA, 23 nt, Homo sapiens
auguagaaaacuuuuacaucugc

SEQ ID NO: 3408 - RNA, 23 nt, Homo sapiens
ucagcgugcuuauagacguuacc

SEQ ID NO: 3409 - RNA, 23 nt, Homo sapiens
auguuucuagcugauuugauuga

SEQ ID NO: 3410 - RNA, 23 nt, Homo sapiens
cugcccaaaauacugauaauagu

SEQ ID NO: 3411 - RNA, 23 nt, Homo sapiens
cauuuguccuaaucuacguauaa

SEQ ID NO: 3412 - RNA, 23 nt, Homo sapiens
uauaaucgcugaacuuauuacac

SEQ ID NO: 3413 - RNA, 23 nt, Homo sapiens
aauuugaauucaaucuaccguua

SEQ ID NO: 3414 - RNA, 23 nt, Homo sapiens
aacucuuuugaggaagucuaugc

SEQ ID NO: 3415 - RNA, 23 nt, Homo sapiens
cuagcugauuugauugaaacgua

SEQ ID NO: 3416 - RNA, 23 nt, Homo sapiens
uucuuuauaccaucuuagguuca

SEQ ID NO: 3417 - RNA, 23 nt, Homo sapiens
gguugcaagccucuuaugugagg

SEQ ID NO: 3418 - RNA, 23 nt, Homo sapiens
auuuauugcaucacuuguauaca

SEQ ID NO: 3419 - RNA, 23 nt, Homo sapiens
cuuuucacaggauuguaauuagu

SEQ ID NO: 3420 - RNA, 23 nt, Homo sapiens
aucuuuucacaggauuguaauua

SEQ ID NO: 3421 - RNA, 23 nt, Homo sapiens
cucuguaggaauuauugauuaua

SEQ ID NO: 3422 - RNA, 23 nt, Homo sapiens
ccuuccugauaugcaguuaguug

SEQ ID NO: 3423 - RNA, 23 nt, Homo sapiens
cugcaagucaaguuccaaaucgu

SEQ ID NO: 3424 - RNA, 23 nt, Homo sapiens
auggaagaaagguucaugucugc

SEQ ID NO: 3425 - RNA, 23 nt, Homo sapiens
caaucuagggcuaaagauucuuu

SEQ ID NO: 3426 - RNA, 23 nt, Homo sapiens
ucuagcugauuugauugaaacgu

SEQ ID NO: 3427 - RNA, 23 nt, Homo sapiens
uccuuccugauaugcaguuaguu

SEQ ID NO: 3428 - RNA, 23 nt, Homo sapiens
gcacugaugauucuuuaagaauc

SEQ ID NO: 3429 - RNA, 23 nt, Homo sapiens
auagacguuaccgcuuaaggcaa

SEQ ID NO: 3430 - RNA, 23 nt, Homo sapiens
auucguggcuccuuguuuucugc

SEQ ID NO: 3431 - RNA, 23 nt, Homo sapiens
agccuuucuucuuucauaucccu

SEQ ID NO: 3432 - RNA, 23 nt, Homo sapiens
gucaucuuuucacaggauuguaa

SEQ ID NO: 3433 - RNA, 23 nt, Homo sapiens
gccuguuggaaauagguuuugau

SEQ ID NO: 3434 - RNA, 23 nt, Homo sapiens
uggggagauggauucucuucguu

SEQ ID NO: 3435 - RNA, 23 nt, Homo sapiens
auuugaauucaaucuaccguuau

SEQ ID NO: 3436 - RNA, 23 nt, Homo sapiens
auucaucuuaggcuauuugaacc

SEQ ID NO: 3437 - RNA, 23 nt, Homo sapiens
gaugauucuuuaagaaucguaag

SEQ ID NO: 3438 - RNA, 23 nt, Homo sapiens
aaguaauggacauuaguuaugaa

SEQ ID NO: 3439 - RNA, 23 nt, Homo sapiens
acuugagacugacacauuguaau

SEQ ID NO: 3440 - RNA, 23 nt, Homo sapiens
uugaauucaaucuaccguuauuu

SEQ ID NO: 3441 - RNA, 23 nt, Homo sapiens
ugaugauucuuuaagaaucguaa

SEQ ID NO: 3442 - RNA, 23 nt, Homo sapiens
caagccuguuggaaauagguuuu

SEQ ID NO: 3443 - RNA, 23 nt, Homo sapiens
agcgugcuuauagacguuaccgc

SEQ ID NO: 3444 - RNA, 23 nt, Homo sapiens
acuuuaguggcaaacacucuugg

SEQ ID NO: 3445 - RNA, 23 nt, Homo sapiens
agaccucucuuuccauguagauu

SEQ ID NO: 3446 - RNA, 23 nt, Homo sapiens
accaacuuacuuuccuaaauuau

SEQ ID NO: 3447 - RNA, 23 nt, Homo sapiens
aggcugaaccuaugaauuccgau

SEQ ID NO: 3448 - RNA, 23 nt, Homo sapiens
uuuaucaaaauauucucgaaggc

SEQ ID NO: 3449 - RNA, 23 nt, Homo sapiens
caacauccguuauuacuuugaga

SEQ ID NO: 3450 - RNA, 23 nt, Homo sapiens
ugagacauuuguccuaaucuacg

SEQ ID NO: 3451 - RNA, 23 nt, Homo sapiens
guugccacugaagaaaguacuga

SEQ ID NO: 3452 - RNA, 23 nt, Homo sapiens
ugucaucuuuucacaggauugua

SEQ ID NO: 3453 - RNA, 23 nt, Homo sapiens
gucggacuugguuaccuaucucu

SEQ ID NO: 3454 - RNA, 23 nt, Homo sapiens
cucucuuuccauguagauuacug

SEQ ID NO: 3455 - RNA, 23 nt, Homo sapiens
aaacaacuuucacuaauuugcuu

SEQ ID NO: 3456 - RNA, 23 nt, Homo sapiens
uuuacaacauccguuauuacuuu

SEQ ID NO: 3457 - RNA, 23 nt, Homo sapiens
auaaugucggacuugguuaccua

SEQ ID NO: 3458 - RNA, 23 nt, Homo sapiens
uuacaacauccguuauuacuuug

SEQ ID NO: 3459 - RNA, 23 nt, Homo sapiens
gccuucuuagccuuguuuaggcu

SEQ ID NO: 3460 - RNA, 23 nt, Homo sapiens
cuacacagguagaauguaguuuu

SEQ ID NO: 3461 - RNA, 23 nt, Homo sapiens
ggcugaaccuaugaauuccgaug

SEQ ID NO: 3462 - RNA, 23 nt, Homo sapiens
ugauucuuuaagaaucguaagag

SEQ ID NO: 3463 - RNA, 23 nt, Homo sapiens
augauucuuuaagaaucguaaga

SEQ ID NO: 3464 - RNA, 23 nt, Homo sapiens
uuguuucaggaaugucuacuugu

SEQ ID NO: 3465 - RNA, 23 nt, Homo sapiens
ccuauagaaacaaagauuuaugg

SEQ ID NO: 3466 - RNA, 23 nt, Homo sapiens
uuuuacaacauccguuauuacuu

SEQ ID NO: 3467 - RNA, 23 nt, Homo sapiens
uguuucaggaaugucuacuugug

SEQ ID NO: 3468 - RNA, 23 nt, Homo sapiens
cugauaauagucucuuaaacucu

SEQ ID NO: 3469 - RNA, 23 nt, Homo sapiens
acagagguuauucuauauuuuga

SEQ ID NO: 3470 - RNA, 23 nt, Homo sapiens
caucacaaccacacuaaaacgga

SEQ ID NO: 3471 - RNA, 23 nt, Homo sapiens
caacacaauuucuucuuagcauu

SEQ ID NO: 3472 - RNA, 23 nt, Homo sapiens
guucauccuggaaguucaguuga

SEQ ID NO: 3473 - RNA, 23 nt, Homo sapiens
cauugcaucagaaccaauuuaua

SEQ ID NO: 3474 - RNA, 23 nt, Homo sapiens
cauucaucuuaggcuauuugaac

SEQ ID NO: 3475 - RNA, 23 nt, Homo sapiens
aagauucuuuauaccaucuuagg

SEQ ID NO: 3476 - RNA, 23 nt, Homo sapiens
uuauaaucgcugaacuuauuaca

SEQ ID NO: 3477 - RNA, 23 nt, Homo sapiens
acauuuguccuaaucuacguaua

SEQ ID NO: 3478 - RNA, 23 nt, Homo sapiens
acuuuuacaucugccuugucauc

SEQ ID NO: 3479 - RNA, 23 nt, Homo sapiens
agacauuuguccuaaucuacgua

SEQ ID NO: 3480 - RNA, 23 nt, Homo sapiens
auuguuuagucauccuuucgcug

SEQ ID NO: 3481 - RNA, 23 nt, Homo sapiens
cuucuccuuaaaauucuaugaug

SEQ ID NO: 3482 - RNA, 23 nt, Homo sapiens
ucacaggauuguaauuagucuug

SEQ ID NO: 3483 - RNA, 23 nt, Homo sapiens
cuuagguucauucaucuuaggcu

SEQ ID NO: 3484 - RNA, 23 nt, Homo sapiens
aaaacaacuuucacuaauuugcu

SEQ ID NO: 3485 - RNA, 23 nt, Homo sapiens
ucaagccuuugauauuaguauca

SEQ ID NO: 3486 - RNA, 23 nt, Homo sapiens
gccuuucuucuuucauaucccuu

SEQ ID NO: 3487 - RNA, 23 nt, Homo sapiens
uuucacaggauuguaauuagucu

SEQ ID NO: 3488 - RNA, 23 nt, Homo sapiens
uuuugcccuuaugaauguuaguc

SEQ ID NO: 3489 - RNA, 23 nt, Homo sapiens
ugcaucagaaccaauuuauaugu

SEQ ID NO: 3490 - RNA, 23 nt, Homo sapiens
gaauucaaucuaccguuauuuca

SEQ ID NO: 3491 - RNA, 23 nt, Homo sapiens
ccuuucgcuguaagcaaaguuga

SEQ ID NO: 3492 - RNA, 23 nt, Homo sapiens
guauuguuuagucauccuuucgc

SEQ ID NO: 3493 - RNA, 23 nt, Homo sapiens
uugagacauuuguccuaaucuac

SEQ ID NO: 3494 - RNA, 23 nt, Homo sapiens
ucuugccaacuugcucucuugcc

SEQ ID NO: 3495 - RNA, 23 nt, Homo sapiens
ggauguauauuugaccuagugac

SEQ ID NO: 3496 - RNA, 23 nt, Homo sapiens
uucacaggauuguaauuagucuu

SEQ ID NO: 3497 - RNA, 23 nt, Homo sapiens
aagauguuugacagguucgugug

SEQ ID NO: 3498 - RNA, 23 nt, Homo sapiens
auuagcuguagacaucuaguuuu

SEQ ID NO: 3499 - RNA, 23 nt, Homo sapiens
gcuacacagguagaauguaguuu

SEQ ID NO: 3500 - RNA, 23 nt, Homo sapiens
auagucucuuaaacucuuuuguc

SEQ ID NO: 3501 - RNA, 23 nt, Homo sapiens
ccaucacaaccacacuaaaacgg

SEQ ID NO: 3502 - RNA, 23 nt, Homo sapiens
gacauuuguccuaaucuacguau

SEQ ID NO: 3503 - RNA, 23 nt, Homo sapiens
ugcugccaaguuaacauagaguc

SEQ ID NO: 3504 - RNA, 23 nt, Homo sapiens
gcauuagcuguagacaucuaguu

SEQ ID NO: 3505 - RNA, 23 nt, Homo sapiens
uagucucuuaaacucuuuuguca

SEQ ID NO: 3506 - RNA, 23 nt, Homo sapiens
gagacauuuguccuaaucuacgu

SEQ ID NO: 3507 - RNA, 23 nt, Homo sapiens
gauucuuuauaccaucuuagguu

SEQ ID NO: 3508 - RNA, 23 nt, Homo sapiens
uacacagguagaauguaguuuua

SEQ ID NO: 3509 - RNA, 23 nt, Homo sapiens
ccauguagauuacuguuuguacu

SEQ ID NO: 3510 - RNA, 23 nt, Homo sapiens
caucacuuguauacaaucccgug

SEQ ID NO: 3511 - RNA, 23 nt, Homo sapiens
ucauucaucuuaggcuauuugaa

SEQ ID NO: 3512 - RNA, 23 nt, Homo sapiens
uucauucaucuuaggcuauuuga

SEQ ID NO: 3513 - RNA, 23 nt, Homo sapiens
aaagagcuuauuaaguauaagcu

SEQ ID NO: 3514 - RNA, 23 nt, Homo sapiens
acugaugauucuuuaagaaucgu

SEQ ID NO: 3515 - RNA, 23 nt, Homo sapiens
uucaacagauguuagaccgucuu

SEQ ID NO: 3516 - RNA, 23 nt, Homo sapiens
uauugugacuuuaaguuuagugg

SEQ ID NO: 3517 - RNA, 23 nt, Homo sapiens
cuuauugugacuuuaaguuuagu

SEQ ID NO: 3518 - RNA, 23 nt, Homo sapiens
gcuucuguguaggagaauucacu

SEQ ID NO: 3519 - RNA, 23 nt, Homo sapiens
uacaugaucuucuuugucguagu

SEQ ID NO: 3520 - RNA, 23 nt, Homo sapiens
uguguaggagaauucacuuuucu

SEQ ID NO: 3521 - RNA, 23 nt, Homo sapiens
aaugucgaguacacuuuuacugg

SEQ ID NO: 3522 - RNA, 23 nt, Homo sapiens
acaugaucuucuuugucguagug

SEQ ID NO: 3523 - RNA, 23 nt, Homo sapiens
ggaucugagacugaauuugccga

SEQ ID NO: 3524 - RNA, 23 nt, Homo sapiens
caugaucuucuuugucguaguga

SEQ ID NO: 3525 - RNA, 23 nt, Homo sapiens
caaagggaaaacaaucuuccguu

SEQ ID NO: 3526 - RNA, 23 nt, Homo sapiens
uaagcuugaaguaaaauuagacc

SEQ ID NO: 3527 - RNA, 23 nt, Homo sapiens
cuugcuauaggaaauuuggucuu

SEQ ID NO: 3528 - RNA, 23 nt, Homo sapiens
ugaucuucuuugucguagugauu

SEQ ID NO: 3529 - RNA, 23 nt, Homo sapiens
augaucuucuuugucguagugau

SEQ ID NO: 3530 - RNA, 23 nt, Homo sapiens
auuuauugcaucacuuguauaca

SEQ ID NO: 3531 - RNA, 23 nt, Homo sapiens
aacaacacaauuucuucuuagca

SEQ ID NO: 3532 - RNA, 23 nt, Homo sapiens
gccuguuggaaauagguuuugau

SEQ ID NO: 3533 - RNA, 23 nt, Homo sapiens
cuuuuguagaucuugcaauuacc

SEQ ID NO: 3534 - RNA, 23 nt, Homo sapiens
ugugguuucagcacagauucagg

SEQ ID NO: 3535 - RNA, 23 nt, Homo sapiens
uuuugauaguuaccuaguuugca

SEQ ID NO: 3536 - RNA, 23 nt, Homo sapiens
cuacaugaucuucuuugucguag

SEQ ID NO: 3537 - RNA, 23 nt, Homo sapiens
agguuugaacacaaaucuuucgg

SEQ ID NO: 3538 - RNA, 23 nt, Homo sapiens
cuugagacugacacauuguaaua

SEQ ID NO: 3539 - RNA, 23 nt, Homo sapiens
aaaugucgaguacacuuuuacug

SEQ ID NO: 3540 - RNA, 23 nt, Homo sapiens
uuugauaguuaccuaguuugcaa

SEQ ID NO: 3541 - RNA, 23 nt, Homo sapiens
gauauauuuuacaacauccguua

SEQ ID NO: 3542 - RNA, 23 nt, Homo sapiens
uucuuuauaccaucuuagguuca

SEQ ID NO: 3543 - RNA, 23 nt, Homo sapiens
caauguacagagguuauucuaua

SEQ ID NO: 3544 - RNA, 23 nt, Homo sapiens
aggcguuguaguuccuaucuccu

SEQ ID NO: 3545 - RNA, 23 nt, Homo sapiens
gcaagucaaguuccaaaucguuc

SEQ ID NO: 3546 - RNA, 23 nt, Homo sapiens
cugcaagucaaguuccaaaucgu

SEQ ID NO: 3547 - RNA, 23 nt, Homo sapiens
aauuggcagaaacccugauuaug

SEQ ID NO: 3548 - RNA, 23 nt, Homo sapiens
cucugauuuccuaagaaaggugg

SEQ ID NO: 3549 - RNA, 23 nt, Homo sapiens
auucguggcuccuuguuuucugc

SEQ ID NO: 3550 - RNA, 23 nt, Homo sapiens
uggucuuuacuggaaucuuugca

SEQ ID NO: 3551 - RNA, 23 nt, Homo sapiens
uucuucugaaacauccaaacuga

SEQ ID NO: 3552 - RNA, 23 nt, Homo sapiens
acuugcuauaggaaauuuggucu

SEQ ID NO: 3553 - RNA, 23 nt, Homo sapiens
caagccuguuggaaauagguuuu

SEQ ID NO: 3554 - RNA, 23 nt, Homo sapiens
guauguuucuagcugauuugauu

SEQ ID NO: 3555 - RNA, 23 nt, Homo sapiens
gguugcaagccucuuaugugagg

SEQ ID NO: 3556 - RNA, 23 nt, Homo sapiens
acuuuaguggcaaacacucuugg

SEQ ID NO: 3557 - RNA, 23 nt, Homo sapiens
aagacuuaccuuuagaguauugu

SEQ ID NO: 3558 - RNA, 23 nt, Homo sapiens
aaggcguuguaguuccuaucucc

SEQ ID NO: 3559 - RNA, 23 nt, Homo sapiens
ucuuugucguagugauuuuccug

SEQ ID NO: 3560 - RNA, 23 nt, Homo sapiens
accaacuuacuuuccuaaauuau

SEQ ID NO: 3561 - RNA, 23 nt, Homo sapiens
agguauguuucuagcugauuuga

SEQ ID NO: 3562 - RNA, 23 nt, Homo sapiens
gagacagagaugaugauuuacuc

SEQ ID NO: 3563 - RNA, 23 nt, Homo sapiens
gggagauggauucucuucguuca

SEQ ID NO: 3564 - RNA, 23 nt, Homo sapiens
ccuuccugauaugcaguuaguug

SEQ ID NO: 3565 - RNA, 23 nt, Homo sapiens
gucaccuucuccuuaaaauucua

SEQ ID NO: 3566 - RNA, 23 nt, Homo sapiens
uacugauaauagucucuuaaacu

SEQ ID NO: 3567 - RNA, 23 nt, Homo sapiens
uccuaaauuauggaaguaaucuu

SEQ ID NO: 3568 - RNA, 23 nt, Homo sapiens
auucuuuauaccaucuuagguuc

SEQ ID NO: 3569 - RNA, 23 nt, Homo sapiens
ggggagauggauucucuucguuc

SEQ ID NO: 3570 - RNA, 23 nt, Homo sapiens
gcugaauauacaaguauuaggag

SEQ ID NO: 3571 - RNA, 23 nt, Homo sapiens
auguuucuagcugauuugauuga

SEQ ID NO: 3572 - RNA, 23 nt, Homo sapiens
caagucaaguuccaaaucguucc

SEQ ID NO: 3573 - RNA, 23 nt, Homo sapiens
cccaucuguuggaauauucuacu

SEQ ID NO: 3574 - RNA, 23 nt, Homo sapiens
ggcugaaccuaugaauuccgaug

SEQ ID NO: 3575 - RNA, 23 nt, Homo sapiens
aucuuuucacaggauuguaauua

SEQ ID NO: 3576 - RNA, 23 nt, Homo sapiens
ucagcgugcuuauagacguuacc

SEQ ID NO: 3577 - RNA, 23 nt, Homo sapiens
uccuuccugauaugcaguuaguu

SEQ ID NO: 3578 - RNA, 23 nt, Homo sapiens
auggaagaaagguucaugucugc

SEQ ID NO: 3579 - RNA, 23 nt, Homo sapiens
auguagaaaacuuuuacaucugc

SEQ ID NO: 3580 - RNA, 23 nt, Homo sapiens
ugucaucuuuucacaggauugua

SEQ ID NO: 3581 - RNA, 23 nt, Homo sapiens
cugcccaaaauacugauaauagu

SEQ ID NO: 3582 - RNA, 23 nt, Homo sapiens
acuuuuacaucugccuugucauc

SEQ ID NO: 3583 - RNA, 23 nt, Homo sapiens
uuuaggcuaaugacccaagauua

SEQ ID NO: 3584 - RNA, 23 nt, Homo sapiens
agcgugcuuauagacguuaccgc

SEQ ID NO: 3585 - RNA, 23 nt, Homo sapiens
gccuucuuagccuuguuuaggcu

SEQ ID NO: 3586 - RNA, 23 nt, Homo sapiens
guuggaauauucuacuuuguuag

SEQ ID NO: 3587 - RNA, 23 nt, Homo sapiens
ggcugaauauacaaguauuagga

SEQ ID NO: 3588 - RNA, 23 nt, Homo sapiens
ugcugccaaguuaacauagaguc

SEQ ID NO: 3589 - RNA, 23 nt, Homo sapiens
gauggauucucuucguucacaga

SEQ ID NO: 3590 - RNA, 23 nt, Homo sapiens
gagcaaaggucacaauuuccuca

SEQ ID NO: 3591 - RNA, 23 nt, Homo sapiens
guugccacugaagaaaguacuga

SEQ ID NO: 3592 - RNA, 23 nt, Homo sapiens
auccuuccugauaugcaguuagu

SEQ ID NO: 3593 - RNA, 23 nt, Homo sapiens
gucaucuuuucacaggauuguaa

SEQ ID NO: 3594 - RNA, 23 nt, Homo sapiens
uggggagauggauucucuucguu

SEQ ID NO: 3595 - RNA, 23 nt, Homo sapiens
auaaugucggacuugguuaccua

SEQ ID NO: 3596 - RNA, 23 nt, Homo sapiens
guucauccuggaaguucaguuga

SEQ ID NO: 3597 - RNA, 23 nt, Homo sapiens
ggauguauauuugaccuagugac

SEQ ID NO: 3598 - RNA, 23 nt, Homo sapiens
ucagucaccacucagcauucgug

SEQ ID NO: 3599 - RNA, 23 nt, Homo sapiens
gaaucguaagagaacucuguagg

SEQ ID NO: 3600 - RNA, 23 nt, Homo sapiens
aggcugaaccuaugaauuccgau

SEQ ID NO: 3601 - RNA, 23 nt, Homo sapiens
gucggacuugguuaccuaucucu

SEQ ID NO: 3602 - RNA, 23 nt, Homo sapiens
ggagauggauucucuucguucac

SEQ ID NO: 3603 - RNA, 23 nt, Homo sapiens
auagacguuaccgcuuaaggcaa

SEQ ID NO: 3604 - RNA, 23 nt, Homo sapiens
uuuguagaucuugcaauuaccau

SEQ ID NO: 3605 - RNA, 23 nt, Homo sapiens
uuuugcccuuaugaauguuaguc

SEQ ID NO: 3606 - RNA, 23 nt, Homo sapiens
aaggcguuguaguuccuaucucc

SEQ ID NO: 3607 - RNA, 23 nt, Homo sapiens
gcuucuguguaggagaauucacu

SEQ ID NO: 3608 - RNA, 23 nt, Homo sapiens
ugugguuucagcacagauucagg

SEQ ID NO: 3609 - RNA, 23 nt, Homo sapiens
uguguaggagaauucacuuuucu

SEQ ID NO: 3610 - RNA, 23 nt, Homo sapiens
cuuuuguagaucuugcaauuacc

SEQ ID NO: 3611 - RNA, 23 nt, Homo sapiens
agguuugaacacaaaucuuucgg

SEQ ID NO: 3612 - RNA, 23 nt, Homo sapiens
uucuucugaaacauccaaacuga

SEQ ID NO: 3613 - RNA, 23 nt, Homo sapiens
caagucaaguuccaaaucguucc

SEQ ID NO: 3614 - RNA, 23 nt, Homo sapiens
augaucuucuuugucguagugau

SEQ ID NO: 3615 - RNA, 23 nt, Homo sapiens
aaugucgaguacacuuuuacugg

SEQ ID NO: 3616 - RNA, 23 nt, Homo sapiens
uacaugaucuucuuugucguagu

SEQ ID NO: 3617 - RNA, 23 nt, Homo sapiens
caaagggaaaacaaucuuccguu

SEQ ID NO: 3618 - RNA, 23 nt, Homo sapiens
ggagauggauucucuucguucac

SEQ ID NO: 3619 - RNA, 23 nt, Homo sapiens
uuugauaguuaccuaguuugcaa

SEQ ID NO: 3620 - RNA, 23 nt, Homo sapiens
gauauauuuuacaacauccguua

SEQ ID NO: 3621 - RNA, 23 nt, Homo sapiens
acuugcuauaggaaauuuggucu

SEQ ID NO: 3622 - RNA, 23 nt, Homo sapiens
ugaucuucuuugucguagugauu

SEQ ID NO: 3623 - RNA, 23 nt, Homo sapiens
gaaucguaagagaacucuguagg

SEQ ID NO: 3624 - RNA, 23 nt, Homo sapiens
aggcguuguaguuccuaucuccu

SEQ ID NO: 3625 - RNA, 23 nt, Homo sapiens
acaugaucuucuuugucguagug

SEQ ID NO: 3626 - RNA, 23 nt, Homo sapiens
aagcuguuuacauaggauucuuu

SEQ ID NO: 3627 - RNA, 23 nt, Homo sapiens
gucaccuucuccuuaaaauucua

SEQ ID NO: 3628 - RNA, 23 nt, Homo sapiens
uauugugacuuuaaguuuagugg

SEQ ID NO: 3629 - RNA, 23 nt, Homo sapiens
auucuuuauaccaucuuagguuc

SEQ ID NO: 3630 - RNA, 23 nt, Homo sapiens
gggagauggauucucuucguuca

SEQ ID NO: 3631 - RNA, 23 nt, Homo sapiens
uuuugauaguuaccuaguuugca

SEQ ID NO: 3632 - RNA, 23 nt, Homo sapiens
gagacagagaugaugauuuacuc

SEQ ID NO: 3633 - RNA, 23 nt, Homo sapiens
caauguacagagguuauucuaua

SEQ ID NO: 3634 - RNA, 23 nt, Homo sapiens
guauguuucuagcugauuugauu

SEQ ID NO: 3635 - RNA, 23 nt, Homo sapiens
aacaacacaauuucuucuuagca

SEQ ID NO: 3636 - RNA, 23 nt, Homo sapiens
cugcaagucaaguuccaaaucgu

SEQ ID NO: 3637 - RNA, 23 nt, Homo sapiens
auaaugucggacuugguuaccua

SEQ ID NO: 3638 - RNA, 23 nt, Homo sapiens
cccaucuguuggaauauucuacu

SEQ ID NO: 3639 - RNA, 23 nt, Homo sapiens
guuggaauauucuacuuuguuag

SEQ ID NO: 3640 - RNA, 23 nt, Homo sapiens
uacugauaauagucucuuaaacu

SEQ ID NO: 3641 - RNA, 23 nt, Homo sapiens
aauuggcagaaacccugauuaug

SEQ ID NO: 3642 - RNA, 23 nt, Homo sapiens
gagcaaaggucacaauuuccuca

SEQ ID NO: 3643 - RNA, 23 nt, Homo sapiens
ggcugaaccuaugaauuccgaug

SEQ ID NO: 3644 - RNA, 23 nt, Homo sapiens
auggaagaaagguucaugucugc

SEQ ID NO: 3645 - RNA, 23 nt, Homo sapiens
caagccuguuggaaauagguuuu

SEQ ID NO: 3646 - RNA, 23 nt, Homo sapiens
auuuauugcaucacuuguauaca

SEQ ID NO: 3647 - RNA, 23 nt, Homo sapiens
gccuguuggaaauagguuuugau

SEQ ID NO: 3648 - RNA, 23 nt, Homo sapiens
ggaucugagacugaauuugccga

SEQ ID NO: 3649 - RNA, 23 nt, Homo sapiens
ucagcgugcuuauagacguuacc

SEQ ID NO: 3650 - RNA, 23 nt, Homo sapiens
auccuuccugauaugcaguuagu

SEQ ID NO: 3651 - RNA, 23 nt, Homo sapiens
auguagaaaacuuuuacaucugc

SEQ ID NO: 3652 - RNA, 23 nt, Homo sapiens
cugcccaaaauacugauaauagu

SEQ ID NO: 3653 - RNA, 23 nt, Homo sapiens
uggucuuuacuggaaucuuugca

SEQ ID NO: 3654 - RNA, 23 nt, Homo sapiens
uaagcuugaaguaaaauuagacc

SEQ ID NO: 3655 - RNA, 23 nt, Homo sapiens
gauggauucucuucguucacaga

SEQ ID NO: 3656 - RNA, 23 nt, Homo sapiens
acuuuaguggcaaacacucuugg

SEQ ID NO: 3657 - RNA, 23 nt, Homo sapiens
cuacaugaucuucuuugucguag

SEQ ID NO: 3658 - RNA, 23 nt, Homo sapiens
gucaucuuuucacaggauuguaa

SEQ ID NO: 3659 - RNA, 23 nt, Homo sapiens
cucugauuuccuaagaaaggugg

SEQ ID NO: 3660 - RNA, 23 nt, Homo sapiens
uucuuuauaccaucuuagguuca

SEQ ID NO: 3661 - RNA, 23 nt, Homo sapiens
agcgugcuuauagacguuaccgc

SEQ ID NO: 3662 - RNA, 23 nt, Homo sapiens
gcaagucaaguuccaaaucguuc

SEQ ID NO: 3663 - RNA, 23 nt, Homo sapiens
ggcugaauauacaaguauuagga

SEQ ID NO: 3664 - RNA, 23 nt, Homo sapiens
auucguggcuccuuguuuucugc

SEQ ID NO: 3665 - RNA, 23 nt, Homo sapiens
auagacguuaccgcuuaaggcaa

SEQ ID NO: 3666 - RNA, 23 nt, Homo sapiens
ugucaucuuuucacaggauugua

SEQ ID NO: 3667 - RNA, 23 nt, Homo sapiens
acuuuuacaucugccuugucauc

SEQ ID NO: 3668 - RNA, 23 nt, Homo sapiens
uccuuccugauaugcaguuaguu

SEQ ID NO: 3669 - RNA, 23 nt, Homo sapiens
gcugaauauacaaguauuaggag

SEQ ID NO: 3670 - RNA, 23 nt, Homo sapiens
auguuucuagcugauuugauuga

SEQ ID NO: 3671 - RNA, 23 nt, Homo sapiens
guugccacugaagaaaguacuga

SEQ ID NO: 3672 - RNA, 23 nt, Homo sapiens
caugaucuucuuugucguaguga

SEQ ID NO: 3673 - RNA, 23 nt, Homo sapiens
guucauccuggaaguucaguuga

SEQ ID NO: 3674 - RNA, 23 nt, Homo sapiens
ggauguauauuugaccuagugac

SEQ ID NO: 3675 - RNA, 23 nt, Homo sapiens
aaaugucgaguacacuuuuacug

SEQ ID NO: 3676 - RNA, 23 nt, Homo sapiens
cuuauugugacuuuaaguuuagu

SEQ ID NO: 3677 - RNA, 23 nt, Homo sapiens
agguauguuucuagcugauuuga

SEQ ID NO: 3678 - RNA, 23 nt, Homo sapiens
uggggagauggauucucuucguu

SEQ ID NO: 3679 - RNA, 23 nt, Homo sapiens
ccuuccugauaugcaguuaguug

SEQ ID NO: 3680 - RNA, 23 nt, Homo sapiens
accaacuuacuuuccuaaauuau

SEQ ID NO: 3681 - RNA, 23 nt, Homo sapiens
cuugcuauaggaaauuuggucuu

SEQ ID NO: 3682 - RNA, 23 nt, Homo sapiens
uccuaaauuauggaaguaaucuu

SEQ ID NO: 3683 - RNA, 23 nt, Homo sapiens
aagacuuaccuuuagaguauugu

SEQ ID NO: 3684 - RNA, 23 nt, Homo sapiens
gucggacuugguuaccuaucucu

SEQ ID NO: 3685 - RNA, 23 nt, Homo sapiens
ucagucaccacucagcauucgug

SEQ ID NO: 3686 - RNA, 23 nt, Homo sapiens
uuuugcccuuaugaauguuaguc

SEQ ID NO: 3687 - RNA, 23 nt, Homo sapiens
aucuuuucacaggauuguaauua

SEQ ID NO: 3688 - RNA, 23 nt, Homo sapiens
aggcugaaccuaugaauuccgau

SEQ ID NO: 3689 - RNA, 23 nt, Homo sapiens
gccuucuuagccuuguuuaggcu

SEQ ID NO: 3690 - RNA, 23 nt, Homo sapiens
ugcugccaaguuaacauagaguc

SEQ ID NO: 3691 - RNA, 23 nt, Homo sapiens
uuuguagaucuugcaauuaccau

SEQ ID NO: 3692 - RNA, 23 nt, Homo sapiens
uuuaggcuaaugacccaagauua

SEQ ID NO: 3693 - RNA, 23 nt, Homo sapiens
ucuuugucguagugauuuuccug

SEQ ID NO: 3694 - RNA, 23 nt, Homo sapiens
gguugcaagccucuuaugugagg

SEQ ID NO: 3695 - RNA, 21 nt, Artificial Sequence
  source: /note="Description of Artificial Sequence: Synthetic oligonucleotide"
aacaguguucuugcucuauaa

SEQ ID NO: 3696 - RNA, 21 nt, Artificial Sequence
  source: /note="Description of Artificial Sequence: Synthetic oligonucleotide"
aacaguguucuugcucuauaa

SEQ ID NO: 3697 - RNA, 23 nt, Artificial Sequence
  source: /note="Description of Artificial Sequence: Synthetic oligonucleotide"
uuauagagcaagaacacuguuuu

SEQ ID NO: 3698 - RNA, 23 nt, Artificial Sequence
  source: /note="Description of Artificial Sequence: Synthetic oligonucleotide"
uuauagagcaagaacacuguuuu

SEQ ID NO: 3699 - protein, 16 aa, Unknown
  source: /note="Description of Unknown: RFGF sequence"
AAVALLPAVLLALLAP

SEQ ID NO: 3700 - protein, 11 aa, Unknown
  source: /note="Description of Unknown: RFGF analogue sequence"
AALLPVLLAAP

SEQ ID NO: 3701 - protein, 13 aa, Human immunodeficiency virus
GRKKRRQRRRPPQ

SEQ ID NO: 3702 - protein, 16 aa, Drosophila sp.
RQIKIWFQNRRMKWKK

SEQ ID NO: 3703-3999 - skipped (297 entries)

SEQ ID NO: 4000 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acacaaagggaaaacaaucua

SEQ ID NO: 4001 - DNA, 9752 bp, Homo sapiens
agtctgcttgcaggcggtcgccagcgctccagcggcggctgtcggctttccaattccgccagctcggctgaggctgggctagcctgggtgccagtggctgctagcggcaggcgtcccctgagcaacaggagcccagagaaaaagaagcagccctgagagagcgccggggaaggagaggcccgcgccctctcctggagccagattctgcaggtgcactgggtggggatgatcggcgggctaggttgcaagcctcttatgtgaggagctgaagaggaattaaaatatacaggatgaaaagatggcaatgttgcctcccccaggacctcagagctttgtccatttcacaaaacagtctcttgccctcattgaacaacgcattgctgaaagaaaatcaaaggaacccaaagaagaaaagaaagatgatgatgaagaagccccaaagccaagcagtgacttggaagctggcaaacagctgcccttcatctatggggacattcctcccggcatggtgtcagagcccctggaggacttggacccctactatgcagacaaaaagactttcatagtattgaacaaagggaaaacaatcttccgtttcaatgccacacctgctttatatatgctttctcctttcagtcctctaagaagaatatctattaagattttagtacactccttattcagcatgctcatcatgtgcactattctgacaaactgcatatttatgaccatgaataacccaccggactggaccaaaaatgtcgagtacacttttactggaatatatacttttgaatcacttgtaaaaatccttgcaagaggcttctgtgtaggagaattcacttttcttcgtgacccgtggaactggctggattttgtcgtcattgtttttgcgtatttaacagaatttgtaaacctaggcaatgtttcagctcttcgaactttcagagtattgagagctttgaaaactatttctgtaatcccaggcctgaagacaattgtaggggctttgatccagtcagtgaagaagctttctgatgtcatgatcctgactgtgttctgtctgagtgtgtttgcactaattggactacagctgttcatgggaaacctgaagcataaatgttttcgaaattcacttgaaaataatgaaacattagaaagcataatgaataccctagagagtgaagaagactttagaaaatatttttattacttggaaggatccaaagatgctctcctttgtggtttcagcacagattcaggtcagtgtccagaggggtacacctgtgtgaaaattggcagaaaccctgattatggctacacgagctttgacactttcagctgggccttcttagccttgtttaggctaatgacccaagattactgggaaaacctttaccaacagacgctgcgtgctgctggcaaaacctacatgatcttctttgtcgtagtgattttcctgggctccttttatctaataaacttgatcctggctgtggttgccatggcatatgaagaacagaaccaggcaaacattgaagaagctaaacagaaagaattagaatttcaacagatgttagaccgtcttaaaaaagagcaagaagaagctgaggcaattgcagcggcagcggctgaatatacaagtattaggagaagcagaattatgggcctctcagagagttcttctgaaacatccaaactgagctctaaaagtgctaaagaaagaagaaacagaagaaagaaaaagaatcaaaagaagctctccagtggagaggaaaagggagatgctgagaaattgtcgaaatcagaatcagaggacagcatcagaagaaaaagtttccaccttggtgtcgaagggcataggcgagcacatgaaaagaggttgtctacccccaatcagtcaccactcagcattcgtggctccttgttttctgcaaggcgaagcagcagaacaagtctttttagtttcaaaggcagaggaagagatataggatctgagactgaatttgccgatgatgagcacagcatttttggagacaatgagagcagaaggggctcactgtttgtgccccacagaccccaggagcgacgcagcagtaacatcagccaagccagtaggtccccaccaatgctgccggtgaacgggaaaatgcacagtgctgtggactgcaacggtgtggtctccctggttgatggacgctcagccctcatgctccccaatggacagcttctgccagaggtgataatagataaggcaacttctgatgacagcggcacgaccaatcaaatacacaagaaaaggcgttgtagttcctatctcctttcagaggatatgctgaatgatcccaacctcagacagagagcaatgagtagagcaagcatattaacaaacactgtggaagaacttgaagagtccagacaaaaatgtccaccttggtggtacagatttgcacacaaattcttgatctggaattgctctccatattggataaaattcaaaaagtgtatctattttattgtaatggatccttttgtagatcttgcaattaccatttgcatagttttaaacacattatttatggctatggaacaccacccaatgactgaggaattcaaaaatgtacttgctataggaaatttggtctttactggaatctttgcagctgaaatggtattaaaactgattgccatggatccatatgagtatttccaagtaggctggaatatttttgacagccttattgtgactttaagtttagtggagctctttctagcagatgtggaaggattgtcagttctgcgatcattcagactgctccgagtcttcaagttggcaaaatcctggccaacattgaacatgctgattaagatcattggtaactcagtaggggctctaggtaacctcaccttagtgttggccatcatcgtcttcatttttgctgtggtcggcatgcagctctttggtaagagctacaaagaatgtgtctgcaagatcaatgatgactgtacgctcccacggtggcacatgaacgacttcttccactccttcctgattgtgttccgcgtgctgtgtggagagtggatagagaccatgtgggactgtatggaggtcgctggtcaagctatgtgccttattgtttacatgatggtcatggtcattggaaacctggtggtcctaaacctatttctggccttattattgagctcatttagttcagacaatcttacagcaattgaagaagaccctgatgcaaacaacctccagattgcagtgactagaattaaaaagggaataaattatgtgaaacaaaccttacgtgaatttattctaaaagcattttccaaaaagccaaagatttccagggagataagacaagcagaagatctgaatactaagaaggaaaactatatttctaaccatacacttgctgaaatgagcaaaggtcacaatttcctcaaggaaaaagataaaatcagtggttttggaagcagcgtggacaaacacttgatggaagacagtgatggtcaatcatttattcacaatcccagcctcacagtgacagtgccaattgcacctggggaatccgatttggaaaatatgaatgctgaggaacttagcagtgattcggatagtgaatacagcaaagtgagattaaaccggtcaagctcctcagagtgcagcacagttgataaccctttgcctggagaaggagaagaagcagaggctgaacctatgaattccgatgagccagaggcctgtttcacagatggttgtgtatggaggttctcatgctgccaagttaacatagagtcagggaaaggaaaaatctggtggaacatcaggaaaacctgctacaagattgttgaacacagttggtttgaaagcttcattgtcctcatgatcctgctcagcagtggtgccctggcttttgaagatatttatattgaaaggaaaaagaccattaagattatcctggagtatgcagacaagatcttcacttacatcttcattctggaaatgcttctaaaatggatagcatatggttataaaacatatttcaccaatgcctggtgttggctggatttcctaattgttgatgtttctttggttactttagtggcaaacactcttggctactcagatcttggccccattaaatcccttcggacactgagagctttaagacctctaagagccttatctagatttgaaggaatgagggtcgttgtgaatgcactcataggagcaattccttccatcatgaatgtgctacttgtgtgtcttatattctggctgatattcagcatcatgggagtaaatttgtttgctggcaagttctatgagtgtattaacaccacagatgggtcacggtttcctgcaagtcaagttccaaatcgttccgaatgttttgcccttatgaatgttagtcaaaatgtgcgatggaaaaacctgaaagtgaactttgataatgtcggacttggttacctatctctgcttcaagttgcaacttttaagggatggacgattattatgtatgcagcagtggattctgttaatgtagacaagcagcccaaatatgaatatagcctctacatgtatatttattttgtcgtctttatcatctttgggtcattcttcactttgaacttgttcattggtgtcatcatagataatttcaaccaacagaaaaagaagcttggaggtcaagacatctttatgacagaagaacagaagaaatactataatgcaatgaaaaagctggggtccaagaagccacaaaagccaattcctcgaccagggaacaaaatccaaggatgtatatttgacctagtgacaaatcaagcctttgatattagtatcatggttcttatctgtctcaacatggtaaccatgatggtagaaaaggagggtcaaagtcaacatatgactgaagttttatattggataaatgtggtttttataatccttttcactggagaatgtgtgctaaaactgatctccctcagacactactacttcactgtaggatggaatatttttgattttgtggttgtgattatctccattgtaggtatgtttctagctgatttgattgaaacgtattttgtgtcccctaccctgttccgagtgatccgtcttgccaggattggccgaatcctacgtctagtcaaaggagcaaaggggatccgcacgctgctctttgctttgatgatgtcccttcctgcgttgtttaacatcggcctcctgctcttcctggtcatgttcatctacgccatctttggaatgtccaactttgcctatgttaaaaaggaagatggaattaatgacatgttcaattttgagacctttggcaacagtatgatttgcctgttccaaattacaacctctgctggctgggatggattgctagcacctattcttaacagtaagccacccgactgtgacccaaaaaaagttcatcctggaagttcagttgaaggagactgtggtaacccatctgttggaatattctactttgttagttatatcatcatatccttcctggttgtggtgaacatgtacattgcagtcatactggagaattttagtgttgccactgaagaaagtactgaacctctgagtgaggatgactttgagatgttctatgaggtttgggagaagtttgatcccgatgcgacccagtttatagagttctctaaactctctgattttgcagctgccctggatcctcctcttctcatagcaaaacccaacaaagtccagctcattgccatggatctgcccatggttagtggtgaccggatccattgtcttgacatcttatttgcttttacaaagcgtgttttgggtgagagtggggagatggattctcttcgttcacagatggaagaaaggttcatgtctgcaaatccttccaaagtgtcctatgaacccatcacaaccacactaaaacggaaacaagaggatgtgtctgctactgtcattcagcgtgcttatagacgttaccgcttaaggcaaaatgtcaaaaatatatcaagtatatacataaaagatggagacagagatgatgatttactcaataaaaaagatatggcttttgataatgttaatgagaactcaagtccagaaaaaacagatgccacttcatccaccacctctccaccttcatatgatagtgtaacaaagccagacaaagagaaatatgaacaagacagaacagaaaaggaagacaaagggaaagacagcaaggaaagcaaaaaatagagcttcatttttgatatattgtttacagcctgtgaaagtgatttatttgtgttaataaaactcttttgaggaagtctatgccaaaatcctttttatcaaaatattctcgaaggcagtgcagtcactaactctgatttcctaagaaaggtgggcagcattagcagatggttatttttgcactgatgattctttaagaatcgtaagagaactctgtaggaattattgattatagcatacaaaagtgattcagttttttggtttttaataaatcagaagaccatgtagaaaacttttacatctgccttgtcatcttttcacaggattgtaattagtcttgtttcccatgtaaataaacaacacacgcatacagaaaaatctattatttatctattatttggaaatcaacaaaagtatttgccttggctttgcaatgaaatgcttgatagaagtaatggacattagttatgaatgtttagttaaaatgcattattagggagcttgactttttatcaatgtacagaggttattctatattttgaggtgcttaaatttattctacattgcatcagaaccaatttatatgtgcctataaaatgccatgggattaaaaatatatgtaggctattcatttctacaaatgtttttcattcatcttgactcacatgccaacaaggataagacttacctttagagtattgtgtttcatagcctttcttctttcatatccctttttgttcatagaataaccacagaacttgaaaaattattctaagtacatattacactcctcaaaaaaaacaaagataactgagaaaaaagttattgacagaagttctatttgctattatttacatagcctaacatttgactgtgctgcccaaaatactgataatagtctcttaaactcttttgtcaaattttcctgctttcttatgcagtattgtttagtcatcctttcgctgtaagcaaagttgatgaaatccttcctgatatgcagttagttgtttgaccacggtacatacttgagcagataataacttgggcacagtatttattgcatcacttgtatacaatcccgtgtttggcaagctttcaaatcatgtaatatgacagactttacacagatatgtgtttagtatgaataaaaaagcattgaaatagggattcttgccaacttgctctcttgccaccaacttactttcctaaattatggaagtaatcttttttggatatacttcaatgtatacaatgaggaagatgtcaccttctccttaaaattctatgatgtgaaatatattttgcctcaatcaacacagtaccatgggcttctaatttatcaagcacatattcattttgcattagctgtagacatctagttttttgaaaacacctattaatagtaatttgaaaagaaataaccataatgctttttttcgtgagtttatttcaggaatatgagatctttcttctataaagttattcatgcacaggcaaaaattgagctacacaggtagaatgtagttttacttagaagatttttgtgggaggttttgaagcaaatatataaaacaactttcactaatttgctttccatatttaaaaaataataaattacatttatataataaatgtttaaagcacatattttttgttgttctggcaatttaaaaagaaagaggatttaaacgtacctatagaaacaaagatttatggttaaagaatgagatcagaagtctagaatgtttttaaattgtgatatattttacaacatccgttattactttgagacatttgtcctaatctacgtataaaactcaatctagggctaaagattctttataccatcttaggttcattcatcttaggctatttgaaccactttttaatttaatatgaaagacaccatgcagtgttttccgagactacatagatcattttatcacatacctaccaagcctgttggaaataggttttgataatttaagtagggacctatacaaaatatattacatttatcagatttttaaatacattcaattaagaatttaacatcaccttaaatttgaattcaatctaccgttatttcaaactcacaaatataactgcattatgaatacttacataatgtagtaagacaagatgtttgacaggttcgtgtgtaattttctattaatgtttttacattgccttgtttttatgtaaaataaaaaatatgggcaactggtttgttaacaacacaatttcttcttagcatttcaaaaatatatataaagttgttctttttcctatttcatgaactatgtttttttttaaaataacatggttaagttttatatatatttacgtttgtttcaggaatgtctacttgtgactttttatcaattaaaaataatatttggaagaaagagcttattaagtataagcttgaagtaaaattagacctctctttccatgtagattactgtttgtactgatggtttcacccttcagaaggcactgtcatattaatatttaaattttataatcgctgaacttattacacccaacaatacagaaaggcagttacactgaagaacttaacttagaataaaatggaagcaaacaggttttctaaaaacttttttaagtgaccaggtctcgctctgtcacccaggctagagtgcaatggcatgatcatagctctctgcagcctcaactctgggctcaagcaaccctcctgcctcagcctcccaagtagctaagactacaggtacatgccaccatgcctggctaatatttaaatttttgtagataaggggtcttgctatgttgcccaggctagtctcaaactcctggcttcaagtgttcctactgtcatgacctgccaacatgctggggttacaggcatgagccaccatgccccaaacaggtttgaacacaaatctttcggatgaaaattagagaacctaattttagctttttgatagttacctagtttgcaaaagatttgggtgacttgtgagctgtttttaaatgctgattgttgaacatcacaacccaaaatacttagcatgattttatagagttttgatagctttattaaaaagagtgaaaataaaatgcatatgtaaataaagcagttctaaatagctatttcagagaaatgttaatagaagtgctgaaagaagggccaactaaattaggatggccagggaattggcctgggtttaggacctatgtatgaaggccaccaattttttaaaaatatctgtggtttattatgttattatcttcttgaggaaaacaatcaagaattgcttcatgaaaataaataaatagccatgaatatcataaagctgtttacataggattctttacaaatttcatagatctatgaatgctcaaaatgtttgagtttgccataaattatattgtagttatattgtagttatacttgagactgacacattgtaatataatctaagaataaaagttatacaaaataaaa

SEQ ID NO: 4002 - DNA, 9752 bp, Homo sapiens
ttttattttgtataacttttattcttagattatattacaatgtgtcagtctcaagtataactacaatataactacaatataatttatggcaaactcaaacattttgagcattcatagatctatgaaatttgtaaagaatcctatgtaaacagctttatgatattcatggctatttatttattttcatgaagcaattcttgattgttttcctcaagaagataataacataataaaccacagatatttttaaaaaattggtggccttcatacataggtcctaaacccaggccaattccctggccatcctaatttagttggcccttctttcagcacttctattaacatttctctgaaatagctatttagaactgctttatttacatatgcattttattttcactctttttaataaagctatcaaaactctataaaatcatgctaagtattttgggttgtgatgttcaacaatcagcatttaaaaacagctcacaagtcacccaaatcttttgcaaactaggtaactatcaaaaagctaaaattaggttctctaattttcatccgaaagatttgtgttcaaacctgtttggggcatggtggctcatgcctgtaaccccagcatgttggcaggtcatgacagtaggaacacttgaagccaggagtttgagactagcctgggcaacatagcaagaccccttatctacaaaaatttaaatattagccaggcatggtggcatgtacctgtagtcttagctacttgggaggctgaggcaggagggttgcttgagcccagagttgaggctgcagagagctatgatcatgccattgcactctagcctgggtgacagagcgagacctggtcacttaaaaaagtttttagaaaacctgtttgcttccattttattctaagttaagttcttcagtgtaactgcctttctgtattgttgggtgtaataagttcagcgattataaaatttaaatattaatatgacagtgccttctgaagggtgaaaccatcagtacaaacagtaatctacatggaaagagaggtctaattttacttcaagcttatacttaataagctctttcttccaaatattatttttaattgataaaaagtcacaagtagacattcctgaaacaaacgtaaatatatataaaacttaaccatgttattttaaaaaaaaacatagttcatgaaataggaaaaagaacaactttatatatatttttgaaatgctaagaagaaattgtgttgttaacaaaccagttgcccatattttttattttacataaaaacaaggcaatgtaaaaacattaatagaaaattacacacgaacctgtcaaacatcttgtcttactacattatgtaagtattcataatgcagttatatttgtgagtttgaaataacggtagattgaattcaaatttaaggtgatgttaaattcttaattgaatgtatttaaaaatctgataaatgtaatatattttgtataggtccctacttaaattatcaaaacctatttccaacaggcttggtaggtatgtgataaaatgatctatgtagtctcggaaaacactgcatggtgtctttcatattaaattaaaaagtggttcaaatagcctaagatgaatgaacctaagatggtataaagaatctttagccctagattgagttttatacgtagattaggacaaatgtctcaaagtaataacggatgttgtaaaatatatcacaatttaaaaacattctagacttctgatctcattctttaaccataaatctttgtttctataggtacgtttaaatcctctttctttttaaattgccagaacaacaaaaaatatgtgctttaaacatttattatataaatgtaatttattattttttaaatatggaaagcaaattagtgaaagttgttttatatatttgcttcaaaacctcccacaaaaatcttctaagtaaaactacattctacctgtgtagctcaatttttgcctgtgcatgaataactttatagaagaaagatctcatattcctgaaataaactcacgaaaaaaagcattatggttatttcttttcaaattactattaataggtgttttcaaaaaactagatgtctacagctaatgcaaaatgaatatgtgcttgataaattagaagcccatggtactgtgttgattgaggcaaaatatatttcacatcatagaattttaaggagaaggtgacatcttcctcattgtatacattgaagtatatccaaaaaagattacttccataatttaggaaagtaagttggtggcaagagagcaagttggcaagaatccctatttcaatgcttttttattcatactaaacacatatctgtgtaaagtctgtcatattacatgatttgaaagcttgccaaacacgggattgtatacaagtgatgcaataaatactgtgcccaagttattatctgctcaagtatgtaccgtggtcaaacaactaactgcatatcaggaaggatttcatcaactttgcttacagcgaaaggatgactaaacaatactgcataagaaagcaggaaaatttgacaaaagagtttaagagactattatcagtattttgggcagcacagtcaaatgttaggctatgtaaataatagcaaatagaacttctgtcaataacttttttctcagttatctttgttttttttgaggagtgtaatatgtacttagaataatttttcaagttctgtggttattctatgaacaaaaagggatatgaaagaagaaaggctatgaaacacaatactctaaaggtaagtcttatccttgttggcatgtgagtcaagatgaatgaaaaacatttgtagaaatgaatagcctacatatatttttaatcccatggcattttataggcacatataaattggttctgatgcaatgtagaataaatttaagcacctcaaaatatagaataacctctgtacattgataaaaagtcaagctccctaataatgcattttaactaaacattcataactaatgtccattacttctatcaagcatttcattgcaaagccaaggcaaatacttttgttgatttccaaataatagataaataatagatttttctgtatgcgtgtgttgtttatttacatgggaaacaagactaattacaatcctgtgaaaagatgacaaggcagatgtaaaagttttctacatggtcttctgatttattaaaaaccaaaaaactgaatcacttttgtatgctataatcaataattcctacagagttctcttacgattcttaaagaatcatcagtgcaaaaataaccatctgctaatgctgcccacctttcttaggaaatcagagttagtgactgcactgccttcgagaatattttgataaaaaggattttggcatagacttcctcaaaagagttttattaacacaaataaatcactttcacaggctgtaaacaatatatcaaaaatgaagctctattttttgctttccttgctgtctttccctttgtcttccttttctgttctgtcttgttcatatttctctttgtctggctttgttacactatcatatgaaggtggagaggtggtggatgaagtggcatctgttttttctggacttgagttctcattaacattatcaaaagccatatcttttttattgagtaaatcatcatctctgtctccatcttttatgtatatacttgatatatttttgacattttgccttaagcggtaacgtctataagcacgctgaatgacagtagcagacacatcctcttgtttccgttttagtgtggttgtgatgggttcataggacactttggaaggatttgcagacatgaacctttcttccatctgtgaacgaagagaatccatctccccactctcacccaaaacacgctttgtaaaagcaaataagatgtcaagacaatggatccggtcaccactaaccatgggcagatccatggcaatgagctggactttgttgggttttgctatgagaagaggaggatccagggcagctgcaaaatcagagagtttagagaactctataaactgggtcgcatcgggatcaaacttctcccaaacctcatagaacatctcaaagtcatcctcactcagaggttcagtactttcttcagtggcaacactaaaattctccagtatgactgcaatgtacatgttcaccacaaccaggaaggatatgatgatataactaacaaagtagaatattccaacagatgggttaccacagtctccttcaactgaacttccaggatgaactttttttgggtcacagtcgggtggcttactgttaagaataggtgctagcaatccatcccagccagcagaggttgtaatttggaacaggcaaatcatactgttgccaaaggtctcaaaattgaacatgtcattaattccatcttcctttttaacataggcaaagttggacattccaaagatggcgtagatgaacatgaccaggaagagcaggaggccgatgttaaacaacgcaggaagggacatcatcaaagcaaagagcagcgtgcggatcccctttgctcctttgactagacgtaggattcggccaatcctggcaagacggatcactcggaacagggtaggggacacaaaatacgtttcaatcaaatcagctagaaacatacctacaatggagataatcacaaccacaaaatcaaaaatattccatcctacagtgaagtagtagtgtctgagggagatcagttttagcacacattctccagtgaaaaggattataaaaaccacatttatccaatataaaacttcagtcatatgttgactttgaccctccttttctaccatcatggttaccatgttgagacagataagaaccatgatactaatatcaaaggcttgatttgtcactaggtcaaatatacatccttggattttgttccctggtcgaggaattggcttttgtggcttcttggaccccagctttttcattgcattatagtatttcttctgttcttctgtcataaagatgtcttgacctccaagcttctttttctgttggttgaaattatctatgatgacaccaatgaacaagttcaaagtgaagaatgacccaaagatgataaagacgacaaaataaatatacatgtagaggctatattcatatttgggctgcttgtctacattaacagaatccactgctgcatacataataatcgtccatcccttaaaagttgcaacttgaagcagagataggtaaccaagtccgacattatcaaagttcactttcaggtttttccatcgcacattttgactaacattcataagggcaaaacattcggaacgatttggaacttgacttgcaggaaaccgtgacccatctgtggtgttaatacactcatagaacttgccagcaaacaaatttactcccatgatgctgaatatcagccagaatataagacacacaagtagcacattcatgatggaaggaattgctcctatgagtgcattcacaacgaccctcattccttcaaatctagataaggctcttagaggtcttaaagctctcagtgtccgaagggatttaatggggccaagatctgagtagccaagagtgtttgccactaaagtaaccaaagaaacatcaacaattaggaaatccagccaacaccaggcattggtgaaatatgttttataaccatatgctatccattttagaagcatttccagaatgaagatgtaagtgaagatcttgtctgcatactccaggataatcttaatggtctttttcctttcaatataaatatcttcaaaagccagggcaccactgctgagcaggatcatgaggacaatgaagctttcaaaccaactgtgttcaacaatcttgtagcaggttttcctgatgttccaccagatttttcctttccctgactctatgttaacttggcagcatgagaacctccatacacaaccatctgtgaaacaggcctctggctcatcggaattcataggttcagcctctgcttcttctccttctccaggcaaagggttatcaactgtgctgcactctgaggagcttgaccggtttaatctcactttgctgtattcactatccgaatcactgctaagttcctcagcattcatattttccaaatcggattccccaggtgcaattggcactgtcactgtgaggctgggattgtgaataaatgattgaccatcactgtcttccatcaagtgtttgtccacgctgcttccaaaaccactgattttatctttttccttgaggaaattgtgacctttgctcatttcagcaagtgtatggttagaaatatagttttccttcttagtattcagatcttctgcttgtcttatctccctggaaatctttggctttttggaaaatgcttttagaataaattcacgtaaggtttgtttcacataatttattccctttttaattctagtcactgcaatctggaggttgtttgcatcagggtcttcttcaattgctgtaagattgtctgaactaaatgagctcaataataaggccagaaataggtttaggaccaccaggtttccaatgaccatgaccatcatgtaaacaataaggcacatagcttgaccagcgacctccatacagtcccacatggtctctatccactctccacacagcacgcggaacacaatcaggaaggagtggaagaagtcgttcatgtgccaccgtgggagcgtacagtcatcattgatcttgcagacacattctttgtagctcttaccaaagagctgcatgccgaccacagcaaaaatgaagacgatgatggccaacactaaggtgaggttacctagagcccctactgagttaccaatgatcttaatcagcatgttcaatgttggccaggattttgccaacttgaagactcggagcagtctgaatgatcgcagaactgacaatccttccacatctgctagaaagagctccactaaacttaaagtcacaataaggctgtcaaaaatattccagcctacttggaaatactcatatggatccatggcaatcagttttaataccatttcagctgcaaagattccagtaaagaccaaatttcctatagcaagtacatttttgaattcctcagtcattgggtggtgttccatagccataaataatgtgtttaaaactatgcaaatggtaattgcaagatctacaaaaggatccattacaataaaatagatacactttttgaattttatccaatatggagagcaattccagatcaagaatttgtgtgcaaatctgtaccaccaaggtggacatttttgtctggactcttcaagttcttccacagtgtttgttaatatgcttgctctactcattgctctctgtctgaggttgggatcattcagcatatcctctgaaaggagataggaactacaacgccttttcttgtgtatttgattggtcgtgccgctgtcatcagaagttgccttatctattatcacctctggcagaagctgtccattggggagcatgagggctgagcgtccatcaaccagggagaccacaccgttgcagtccacagcactgtgcattttcccgttcaccggcagcattggtggggacctactggcttggctgatgttactgctgcgtcgctcctggggtctgtggggcacaaacagtgagccccttctgctctcattgtctccaaaaatgctgtgctcatcatcggcaaattcagtctcagatcctatatctcttcctctgcctttgaaactaaaaagacttgttctgctgcttcgccttgcagaaaacaaggagccacgaatgctgagtggtgactgattgggggtagacaacctcttttcatgtgctcgcctatgcccttcgacaccaaggtggaaactttttcttctgatgctgtcctctgattctgatttcgacaatttctcagcatctcccttttcctctccactggagagcttcttttgattctttttctttcttctgtttcttctttctttagcacttttagagctcagtttggatgtttcagaagaactctctgagaggcccataattctgcttctcctaatacttgtatattcagccgctgccgctgcaattgcctcagcttcttcttgctcttttttaagacggtctaacatctgttgaaattctaattctttctgtttagcttcttcaatgtttgcctggttctgttcttcatatgccatggcaaccacagccaggatcaagtttattagataaaaggagcccaggaaaatcactacgacaaagaagatcatgtaggttttgccagcagcacgcagcgtctgttggtaaaggttttcccagtaatcttgggtcattagcctaaacaaggctaagaaggcccagctgaaagtgtcaaagctcgtgtagccataatcagggtttctgccaattttcacacaggtgtacccctctggacactgacctgaatctgtgctgaaaccacaaaggagagcatctttggatccttccaagtaataaaaatattttctaaagtcttcttcactctctagggtattcattatgctttctaatgtttcattattttcaagtgaatttcgaaaacatttatgcttcaggtttcccatgaacagctgtagtccaattagtgcaaacacactcagacagaacacagtcaggatcatgacatcagaaagcttcttcactgactggatcaaagcccctacaattgtcttcaggcctgggattacagaaatagttttcaaagctctcaatactctgaaagttcgaagagctgaaacattgcctaggtttacaaattctgttaaatacgcaaaaacaatgacgacaaaatccagccagttccacgggtcacgaagaaaagtgaattctcctacacagaagcctcttgcaaggatttttacaagtgattcaaaagtatatattccagtaaaagtgtactcgacatttttggtccagtccggtgggttattcatggtcataaatatgcagtttgtcagaatagtgcacatgatgagcatgctgaataaggagtgtactaaaatcttaatagatattcttcttagaggactgaaaggagaaagcatatataaagcaggtgtggcattgaaacggaagattgttttccctttgttcaatactatgaaagtctttttgtctgcatagtaggggtccaagtcctccaggggctctgacaccatgccgggaggaatgtccccatagatgaagggcagctgtttgccagcttccaagtcactgcttggctttggggcttcttcatcatcatctttcttttcttctttgggttcctttgattttctttcagcaatgcgttgttcaatgagggcaagagactgttttgtgaaatggacaaagctctgaggtcctgggggaggcaacattgccatcttttcatcctgtatattttaattcctcttcagctcctcacataagaggcttgcaacctagcccgccgatcatccccacccagtgcacctgcagaatctggctccaggagagggcgcgggcctctccttccccggcgctctctcagggctgcttctttttctctgggctcctgttgctcaggggacgcctgccgctagcagccactggcacccaggctagcccagcctcagccgagctggcggaattggaaagccgacagccgccgctggagcgctggcgaccgcctgcaagcagact

SEQ ID NO: 4003 - RNA, 21 nt, Artificial Sequence
  source: /note="Description of Artificial Sequence: Synthetic oligonucleotide"
caaagggaaaacaaucuucca

SEQ ID NO: 4004 - RNA, 21 nt, Artificial Sequence
  source: /note="Description of Artificial Sequence: Synthetic oligonucleotide"
aaagggaaaacaaucuuccga

SEQ ID NO: 4005 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaagggaaaacaaucuuccga

SEQ ID NO: 4006 - RNA, 21 nt, Artificial Sequence
  source: /note="Description of Artificial Sequence: Synthetic oligonucleotide"
aagggaaaacaaucuuccgua

SEQ ID NO: 4007 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aagggaaaacaaucuuccgua

SEQ ID NO: 4008 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aagggaaaacaaucuuccgua

SEQ ID NO: 4009 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aagggaaaacaaucuuccgua

SEQ ID NO: 4010 - RNA, 21 nt, Artificial Sequence
  source: /note="Description of Artificial Sequence: Synthetic oligonucleotide"
aagggaaaacaaucuuccgua

SEQ ID NO: 4011 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aagggaaaacaaucuuccgua

SEQ ID NO: 4012 - RNA, 21 nt, Artificial Sequence
  source: /note="Description of Artificial Sequence: Synthetic oligonucleotide"
aagggaaaacaaucuuccgua

SEQ ID NO: 4013 - RNA, 21 nt, Artificial Sequence
  source: /note="Description of Artificial Sequence: Synthetic oligonucleotide"
aagggaaaacaaucuuccgua

SEQ ID NO: 4014 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aagggaaaacaaucuuccgua

SEQ ID NO: 4015 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aagggaaaacaaucuuccgua

SEQ ID NO: 4016 - RNA, 21 nt, Artificial Sequence
  source: /note="Description of Artificial Sequence: Synthetic oligonucleotide"
agggaaaacaaucuuccguua

SEQ ID NO: 4017 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agggaaaacaaucuuccguua

SEQ ID NO: 4018 - DNA, 19 bp, Artificial Sequence
  source: /note="Description of Artificial Sequence: Synthetic oligonucleotide"
  source: /note="Description of Combined DNA/RNA Molecule: Synthetic oligonucleotide"
gggaaaacaaucuuccgua

SEQ ID NO: 4019 - DNA, 19 bp, Artificial Sequence
  source: /note="Description of Artificial Sequence: Synthetic oligonucleotide"
  source: /note="Description of Combined DNA/RNA Molecule: Synthetic oligonucleotide"
gggaaaacaaucuuccgua

SEQ ID NO: 4020 - RNA, 21 nt, Artificial Sequence
  source: /note="Description of Artificial Sequence: Synthetic oligonucleotide"
gggaaaacaaucuuccguuua

SEQ ID NO: 4021 - RNA, 21 nt, Artificial Sequence
  source: /note="Description of Artificial Sequence: Synthetic oligonucleotide"
ggaaaacaaucuuccguuuca

SEQ ID NO: 4022 - RNA, 21 nt, Artificial Sequence
  source: /note="Description of Artificial Sequence: Synthetic oligonucleotide"
gaaaacaaucuuccguuucaa

SEQ ID NO: 4023 - RNA, 21 nt, Artificial Sequence
  source: /note="Description of Artificial Sequence: Synthetic oligonucleotide"
gaaaacaaucuuccauuucaa

SEQ ID NO: 4024 - RNA, 21 nt, Artificial Sequence
  source: /note="Description of Artificial Sequence: Synthetic oligonucleotide"
aaaacaaucuuccguuucaaa

SEQ ID NO: 4025 - RNA, 21 nt, Artificial Sequence
  source: /note="Description of Artificial Sequence: Synthetic oligonucleotide"
aaaacaaucuuccguuucaaa

SEQ ID NO: 4026 - RNA, 21 nt, Artificial Sequence
  source: /note="Description of Artificial Sequence: Synthetic oligonucleotide"
ugucgaguacacuuuuacuga

SEQ ID NO: 4027 - RNA, 21 nt, Artificial Sequence
  source: /note="Description of Artificial Sequence: Synthetic oligonucleotide"
ugucgaguacacuuuuacuga

SEQ ID NO: 4028 - RNA, 21 nt, Artificial Sequence
  source: /note="Description of Artificial Sequence: Synthetic oligonucleotide"
ugucgaguacacuuuuacuga

SEQ ID NO: 4029 - RNA, 21 nt, Artificial Sequence
  source: /note="Description of Artificial Sequence: Synthetic oligonucleotide"
ugucgaguacacuuuuacuga

SEQ ID NO: 4030 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugucgaguacacuuuuacuga

SEQ ID NO: 4031 - RNA, 21 nt, Artificial Sequence
  source: /note="Description of Artificial Sequence: Synthetic oligonucleotide"
ugucgaguacacuuuuacuga

SEQ ID NO: 4032 - RNA, 21 nt, Artificial Sequence
  source: /note="Description of Artificial Sequence: Synthetic oligonucleotide"
ugucgaguacacuuuuacuga

SEQ ID NO: 4033 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugucgaguacacuuuuacuga

SEQ ID NO: 4034 - RNA, 21 nt, Artificial Sequence
  source: /note="Description of Artificial Sequence: Synthetic oligonucleotide"
ugucgaguacacuuuuacuga

SEQ ID NO: 4035 - RNA, 21 nt, Artificial Sequence
  source: /note="Description of Artificial Sequence: Synthetic oligonucleotide"
ugucgaguacacuuuuacuga

SEQ ID NO: 4036 - RNA, 21 nt, Artificial Sequence
  source: /note="Description of Artificial Sequence: Synthetic oligonucleotide"
ugucgaguacacuuuuacuga

SEQ ID NO: 4037 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugucgaguacacuuuuacuga

SEQ ID NO: 4038 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugucgaguacacuuuuacuga

SEQ ID NO: 4039 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugucgaguacacuuuuacuga

SEQ ID NO: 4040 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugucgaguacacuuuuacuga

SEQ ID NO: 4041 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugucgaguacacuuuuacuga

SEQ ID NO: 4042 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugucgaguacacuuuuacuga

SEQ ID NO: 4043 - RNA, 21 nt, Artificial Sequence
  source: /note="Description of Artificial Sequence: Synthetic oligonucleotide"
ugucgaguacacuuuuacuga

SEQ ID NO: 4044 - RNA, 19 nt, Artificial Sequence
  source: /note="Description of Artificial Sequence: Synthetic oligonucleotide"
ucgaguacacuuuuacuga

SEQ ID NO: 4045 - DNA, 19 bp, Artificial Sequence
  source: /note="Description of Artificial Sequence: Synthetic oligonucleotide"
  source: /note="Description of Combined DNA/RNA Molecule: Synthetic oligonucleotide"
ucgaguacacuuuuacuga

SEQ ID NO: 4046 - RNA, 19 nt, Artificial Sequence
  source: /note="Description of Artificial Sequence: Synthetic oligonucleotide"
ucgaguacacuuuuacuga

SEQ ID NO: 4047 - RNA, 21 nt, Artificial Sequence
  source: /note="Description of Artificial Sequence: Synthetic oligonucleotide"
gaggcuucuguguaggagaaa

SEQ ID NO: 4048 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aggcuucuguguaggagaaua

SEQ ID NO: 4049 - RNA, 21 nt, Artificial Sequence
  source: /note="Description of Artificial Sequence: Synthetic oligonucleotide"
ggcuucuguguaggagaauua

SEQ ID NO: 4050 - RNA, 21 nt, Artificial Sequence
  source: /note="Description of Artificial Sequence: Synthetic oligonucleotide"
gcuucuguguaggagaauuca

SEQ ID NO: 4051 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cuucugugtaggagaauucaa

SEQ ID NO: 4052 - RNA, 21 nt, Artificial Sequence
  source: /note="Description of Artificial Sequence: Synthetic oligonucleotide"
uucuguguaggagaauucaca

SEQ ID NO: 4053 - RNA, 21 nt, Artificial Sequence
  source: /note="Description of Artificial Sequence: Synthetic oligonucleotide"
uucuguguaggagaauucaca

SEQ ID NO: 4054 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uucuguguaggagaauucaca

SEQ ID NO: 4055 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uucuguguaggagaauucaca

SEQ ID NO: 4056 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uucuguguaggagaauucaca

SEQ ID NO: 4057 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uucuguguaggagaauucaca

SEQ ID NO: 4058 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uucuguguaggagaauucaca

SEQ ID NO: 4059 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uucuguguaggagaauucaca

SEQ ID NO: 4060 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucuguguaggagaauucacua

SEQ ID NO: 4061 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cuguguaggagaauucacuua

SEQ ID NO: 4062 - RNA, 21 nt, Artificial Sequence
  source: /note="Description of Artificial Sequence: Synthetic oligonucleotide"
uguguaggagaauucacuuua

SEQ ID NO: 4063 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
guguaggagaauucacuuuua

SEQ ID NO: 4064 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uguaggagaauucacuuuuca

SEQ ID NO: 4065 - RNA, 21 nt, Artificial Sequence
  source: /note="Description of Artificial Sequence: Synthetic oligonucleotide"
uguaggagaauucacuuuuca

SEQ ID NO: 4066 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uguaggagaatucacuuuuca

SEQ ID NO: 4067 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uguaggagaauucacuuuuca

SEQ ID NO: 4068 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uguaggagaauucauuuuuca

SEQ ID NO: 4069 - RNA, 21 nt, Artificial Sequence
  source: /note="Description of Artificial Sequence: Synthetic oligonucleotide"
uguaggagaauucacuuuuca

SEQ ID NO: 4070 - RNA, 21 nt, Artificial Sequence
  source: /note="Description of Artificial Sequence: Synthetic oligonucleotide"
uguaggagaauucacuuuuca

SEQ ID NO: 4071 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uguaggagaatucacuuuuca

SEQ ID NO: 4072 - RNA, 21 nt, Artificial Sequence
  source: /note="Description of Artificial Sequence: Synthetic oligonucleotide"
uguaggagaauucauuuuuca

SEQ ID NO: 4073 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uguaggagaauucacuuuuca

SEQ ID NO: 4074 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uguaggagaatucacuuuuca

SEQ ID NO: 4075 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uguaggagaatucacuuuuca

SEQ ID NO: 4076 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uguaggagaatucauuuuuca

SEQ ID NO: 4077 - RNA, 21 nt, Artificial Sequence
  source: /note="Description of Artificial Sequence: Synthetic oligonucleotide"
uguaggagaauucacuuuuca

SEQ ID NO: 4078 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uguaggagaauucacuuuuca

SEQ ID NO: 4079 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uguaggagaauucacuuuuca

SEQ ID NO: 4080 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uguaggagaauucacuuuuca

SEQ ID NO: 4081 - RNA, 21 nt, Artificial Sequence
  source: /note="Description of Artificial Sequence: Synthetic oligonucleotide"
guaggagaauucacuuuucua

SEQ ID NO: 4082 - RNA, 21 nt, Artificial Sequence
  source: /note="Description of Artificial Sequence: Synthetic oligonucleotide"
guaggagaauucacuuuucua

SEQ ID NO: 4083 - RNA, 21 nt, Artificial Sequence
  source: /note="Description of Artificial Sequence: Synthetic oligonucleotide"
uaggagaauucacuuuucuua

SEQ ID NO: 4084 - RNA, 21 nt, Artificial Sequence
  source: /note="Description of Artificial Sequence: Synthetic oligonucleotide"
uaggagaauucacuuuucuua

SEQ ID NO: 4085 - DNA, 19 bp, Artificial Sequence
  source: /note="Description of Artificial Sequence: Synthetic oligonucleotide"
  source: /note="Description of Combined DNA/RNA Molecule: Synthetic oligonucleotide"
uaggagaauucacuuuuca

SEQ ID NO: 4086 - DNA, 19 bp, Artificial Sequence
  source: /note="Description of Artificial Sequence: Synthetic oligonucleotide"
  source: /note="Description of Combined DNA/RNA Molecule: Synthetic oligonucleotide"
uaggagaauucacuuuuca

SEQ ID NO: 4087 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aggagaauucacuuuucuuca

SEQ ID NO: 4088 - RNA, 21 nt, Artificial Sequence
  source: /note="Description of Artificial Sequence: Synthetic oligonucleotide"
ggagaauucacuuuucuucga

SEQ ID NO: 4089 - RNA, 21 nt, Artificial Sequence
  source: /note="Description of Artificial Sequence: Synthetic oligonucleotide"
ggagaauucacuuuucuucga

SEQ ID NO: 4090 - RNA, 21 nt, Artificial Sequence
  source: /note="Description of Artificial Sequence: Synthetic oligonucleotide"
gagaauucacuuuucuucgua

SEQ ID NO: 4091 - RNA, 21 nt, Artificial Sequence
  source: /note="Description of Artificial Sequence: Synthetic oligonucleotide"
ccugaagcauaaauguuuuca

SEQ ID NO: 4092 - RNA, 21 nt, Artificial Sequence
  source: /note="Description of Artificial Sequence: Synthetic oligonucleotide"
cugaagcauaaauguuuucga

SEQ ID NO: 4093 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cugaagcataaauguuuucga

SEQ ID NO: 4094 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugaagcauaaauguuuucgaa

SEQ ID NO: 4095 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gaagcauaaauguuuucgaaa

SEQ ID NO: 4096 - RNA, 21 nt, Artificial Sequence
  source: /note="Description of Artificial Sequence: Synthetic oligonucleotide"
gaagcauaaauguuuucgaaa

SEQ ID NO: 4097 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aagcauaaauguuuucgaaaa

SEQ ID NO: 4098 - RNA, 21 nt, Artificial Sequence
  source: /note="Description of Artificial Sequence: Synthetic oligonucleotide"
agcauaaauguuuucgaaaua

SEQ ID NO: 4099 - RNA, 21 nt, Artificial Sequence
  source: /note="Description of Artificial Sequence: Synthetic oligonucleotide"
agcauaaauguuuucgaaaua

SEQ ID NO: 4100 - RNA, 21 nt, Artificial Sequence
  source: /note="Description of Artificial Sequence: Synthetic oligonucleotide"
agcauaaauguuuucgaaaua

SEQ ID NO: 4101 - RNA, 21 nt, Artificial Sequence
  source: /note="Description of Artificial Sequence: Synthetic oligonucleotide"
agcauaaauguuuucgaaaua

SEQ ID NO: 4102 - RNA, 21 nt, Artificial Sequence
  source: /note="Description of Artificial Sequence: Synthetic oligonucleotide"
agcauaaauguuuuugaaaua

SEQ ID NO: 4103 - RNA, 21 nt, Artificial Sequence
  source: /note="Description of Artificial Sequence: Synthetic oligonucleotide"
agcauaaauguuuucgaaaua

SEQ ID NO: 4104 - RNA, 21 nt, Artificial Sequence
  source: /note="Description of Artificial Sequence: Synthetic oligonucleotide"
agcauaaauguuuucgaaaua

SEQ ID NO: 4105 - RNA, 21 nt, Artificial Sequence
  source: /note="Description of Artificial Sequence: Synthetic oligonucleotide"
agcauaaauguuuucgaaaua

SEQ ID NO: 4106 - RNA, 21 nt, Artificial Sequence
  source: /note="Description of Artificial Sequence: Synthetic oligonucleotide"
agcauaaauguuuucgaaaua

SEQ ID NO: 4107 - RNA, 21 nt, Artificial Sequence
  source: /note="Description of Artificial Sequence: Synthetic oligonucleotide"
gcauaaauguuuucgaaauua

SEQ ID NO: 4108 - RNA, 21 nt, Artificial Sequence
  source: /note="Description of Artificial Sequence: Synthetic oligonucleotide"
cauaaauguuuucgaaauuca

SEQ ID NO: 4109 - RNA, 19 nt, Artificial Sequence
  source: /note="Description of Artificial Sequence: Synthetic oligonucleotide"
cauaaauguuuucgaaaua

SEQ ID NO: 4110 - RNA, 21 nt, Artificial Sequence
  source: /note="Description of Artificial Sequence: Synthetic oligonucleotide"
auaaauguuuucgaaauucaa

SEQ ID NO: 4111 - RNA, 21 nt, Artificial Sequence
  source: /note="Description of Artificial Sequence: Synthetic oligonucleotide"
auaaauguuuucgaaauucaa

SEQ ID NO: 4112 - RNA, 21 nt, Artificial Sequence
  source: /note="Description of Artificial Sequence: Synthetic oligonucleotide"
uaaauguuuucgaaauucaca

SEQ ID NO: 4113 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaauguuuucgaaauucacua

SEQ ID NO: 4114 - RNA, 21 nt, Artificial Sequence
  source: /note="Description of Artificial Sequence: Synthetic oligonucleotide"
uacaugaucuucuuugucgua

SEQ ID NO: 4115 - RNA, 21 nt, Artificial Sequence
  source: /note="Description of Artificial Sequence: Synthetic oligonucleotide"
uacaugaucuucuuugucgua

SEQ ID NO: 4116 - RNA, 21 nt, Artificial Sequence
  source: /note="Description of Artificial Sequence: Synthetic oligonucleotide"
acaugaucuucuuugucguaa

SEQ ID NO: 4117 - RNA, 21 nt, Artificial Sequence
  source: /note="Description of Artificial Sequence: Synthetic oligonucleotide"
caugaucuucuuugucguaga

SEQ ID NO: 4118 - RNA, 21 nt, Artificial Sequence
  source: /note="Description of Artificial Sequence: Synthetic oligonucleotide"
caugaucuucuuugucguaga

SEQ ID NO: 4119 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
caugaucutctuugucguaga

SEQ ID NO: 4120 - RNA, 21 nt, Artificial Sequence
  source: /note="Description of Artificial Sequence: Synthetic oligonucleotide"
caugaucuucuuugucguaga

SEQ ID NO: 4121 - RNA, 21 nt, Artificial Sequence
  source: /note="Description of Artificial Sequence: Synthetic oligonucleotide"
caugaucuucuuugucguaga

SEQ ID NO: 4122 - RNA, 21 nt, Artificial Sequence
  source: /note="Description of Artificial Sequence: Synthetic oligonucleotide"
caugaucuucuuugucguaga

SEQ ID NO: 4123 - RNA, 21 nt, Artificial Sequence
  source: /note="Description of Artificial Sequence: Synthetic oligonucleotide"
caugaucuucuuugucguaga

SEQ ID NO: 4124 - RNA, 21 nt, Artificial Sequence
  source: /note="Description of Artificial Sequence: Synthetic oligonucleotide"
caugaucuucuuugucguaga

SEQ ID NO: 4125 - RNA, 21 nt, Artificial Sequence
  source: /note="Description of Artificial Sequence: Synthetic oligonucleotide"
caugaucuucuuugucguaga

SEQ ID NO: 4126 - RNA, 21 nt, Artificial Sequence
  source: /note="Description of Artificial Sequence: Synthetic oligonucleotide"
caugaucuucuuugucguaga

SEQ ID NO: 4127 - RNA, 21 nt, Artificial Sequence
  source: /note="Description of Artificial Sequence: Synthetic oligonucleotide"
caugaucuucuuugucguaga

SEQ ID NO: 4128 - RNA, 21 nt, Artificial Sequence
  source: /note="Description of Artificial Sequence: Synthetic oligonucleotide"
augaucuucuuugucguagua

SEQ ID NO: 4129 - RNA, 19 nt, Artificial Sequence
  source: /note="Description of Artificial Sequence: Synthetic oligonucleotide"
ugaucuucuuugucguaga

SEQ ID NO: 4130 - RNA, 21 nt, Artificial Sequence
  source: /note="Description of Artificial Sequence: Synthetic oligonucleotide"
ugaucuucuuugucguaguga

SEQ ID NO: 4131 - RNA, 19 nt, Artificial Sequence
  source: /note="Description of Artificial Sequence: Synthetic oligonucleotide"
ugaucuucuuugucguaga

SEQ ID NO: 4132 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gaucuucuuugucguagugaa

SEQ ID NO: 4133 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gaucuucuuugucguagugaa

SEQ ID NO: 4134 - RNA, 21 nt, Artificial Sequence
  source: /note="Description of Artificial Sequence: Synthetic oligonucleotide"
gaucuucuuugucguagugaa

SEQ ID NO: 4135 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gaucuucuuugucguagugaa

SEQ ID NO: 4136 - RNA, 21 nt, Artificial Sequence
  source: /note="Description of Artificial Sequence: Synthetic oligonucleotide"
gaucuucuuugucguagugaa

SEQ ID NO: 4137 - RNA, 21 nt, Artificial Sequence
  source: /note="Description of Artificial Sequence: Synthetic oligonucleotide"
gaucuucuuugucguagugaa

SEQ ID NO: 4138 - RNA, 21 nt, Artificial Sequence
  source: /note="Description of Artificial Sequence: Synthetic oligonucleotide"
gaucuucuuugucguagugaa

SEQ ID NO: 4139 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gaucuucutugucguagugaa

SEQ ID NO: 4140 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gaucuucuuugucguagugaa

SEQ ID NO: 4141 - RNA, 21 nt, Artificial Sequence
  source: /note="Description of Artificial Sequence: Synthetic oligonucleotide"
gaucuucuuugucguagugaa

SEQ ID NO: 4142 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gaucuucuuugucguagugaa

SEQ ID NO: 4143 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gaucuucuuugucguagugaa

SEQ ID NO: 4144 - RNA, 21 nt, Artificial Sequence
  source: /note="Description of Artificial Sequence: Synthetic oligonucleotide"
gaucuucuuugucguagugaa

SEQ ID NO: 4145 - RNA, 21 nt, Artificial Sequence
  source: /note="Description of Artificial Sequence: Synthetic oligonucleotide"
aucuucuuugucguagugaua

SEQ ID NO: 4146 - DNA, 19 bp, Artificial Sequence
  source: /note="Description of Artificial Sequence: Synthetic oligonucleotide"
  source: /note="Description of Combined DNA/RNA Molecule: Synthetic oligonucleotide"
ucuucuuugucguagugaa

SEQ ID NO: 4147 - DNA, 19 bp, Artificial Sequence
  source: /note="Description of Artificial Sequence: Synthetic oligonucleotide"
  source: /note="Description of Combined DNA/RNA Molecule: Synthetic oligonucleotide"
ucuucuuugucguagugaa

SEQ ID NO: 4148 - RNA, 21 nt, Artificial Sequence
  source: /note="Description of Artificial Sequence: Synthetic oligonucleotide"
ucuucuuugucguagugauua

SEQ ID NO: 4149 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cuucuuugucguagugauuua

SEQ ID NO: 4150 - RNA, 21 nt, Artificial Sequence
  source: /note="Description of Artificial Sequence: Synthetic oligonucleotide"
uucuuugucguagugauuuua

SEQ ID NO: 4151 - RNA, 21 nt, Artificial Sequence
  source: /note="Description of Artificial Sequence: Synthetic oligonucleotide"
ucuuugucguagugauuuuca

SEQ ID NO: 4152 - RNA, 21 nt, Artificial Sequence
  source: /note="Description of Artificial Sequence: Synthetic oligonucleotide"
auccuuuuguagaucuugcaa

SEQ ID NO: 4153 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uccuuuuguagaucuugcaaa

SEQ ID NO: 4154 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccuuuuguagaucuugcaaua

SEQ ID NO: 4155 - RNA, 21 nt, Artificial Sequence
  source: /note="Description of Artificial Sequence: Synthetic oligonucleotide"
cuuuuguagaucuugcaauua

SEQ ID NO: 4156 - RNA, 21 nt, Artificial Sequence
  source: /note="Description of Artificial Sequence: Synthetic oligonucleotide"
uuuuguagaucuugcaauuaa

SEQ ID NO: 4157 - RNA, 21 nt, Artificial Sequence
  source: /note="Description of Artificial Sequence: Synthetic oligonucleotide"
uuuuguagaucuugcaauuaa

SEQ ID NO: 4158 - RNA, 21 nt, Artificial Sequence
  source: /note="Description of Artificial Sequence: Synthetic oligonucleotide"
uuuguagaucuugcaauuaca

SEQ ID NO: 4159 - RNA, 21 nt, Artificial Sequence
  source: /note="Description of Artificial Sequence: Synthetic oligonucleotide"
uuuguagaucuugcaauuaca

SEQ ID NO: 4160 - RNA, 21 nt, Artificial Sequence
  source: /note="Description of Artificial Sequence: Synthetic oligonucleotide"
uuuguagaucuugcaauuaca

SEQ ID NO: 4161 - RNA, 21 nt, Artificial Sequence
  source: /note="Description of Artificial Sequence: Synthetic oligonucleotide"
uuuguagaucuugcaauuaca

SEQ ID NO: 4162 - RNA, 21 nt, Artificial Sequence
  source: /note="Description of Artificial Sequence: Synthetic oligonucleotide"
uuuguagaucuugcaauuaca

SEQ ID NO: 4163 - RNA, 21 nt, Artificial Sequence
  source: /note="Description of Artificial Sequence: Synthetic oligonucleotide"
uuuguagaucuugcaauuaca

SEQ ID NO: 4164 - RNA, 21 nt, Artificial Sequence
  source: /note="Description of Artificial Sequence: Synthetic oligonucleotide"
uuguagaucuugcaauuacca

SEQ ID NO: 4165 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uguagaucuugcaauuaccaa

SEQ ID NO: 4166 - RNA, 21 nt, Artificial Sequence
  source: /note="Description of Artificial Sequence: Synthetic oligonucleotide"
guagaucuugcaauuaccaua

SEQ ID NO: 4167 - RNA, 21 nt, Artificial Sequence
  source: /note="Description of Artificial Sequence: Synthetic oligonucleotide"
uagaucuugcaauuaccauua

SEQ ID NO: 4168 - RNA, 21 nt, Artificial Sequence
  source: /note="Description of Artificial Sequence: Synthetic oligonucleotide"
agaucuugcaauuaccauuua

SEQ ID NO: 4169 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agaucuugcaauuaccauuua

SEQ ID NO: 4170 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uaaauuaugugaaacaaacca

SEQ ID NO: 4171 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aauuaugugaaacaaaccuua

SEQ ID NO: 4172 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auuaugugaaacaaaccuuaa

SEQ ID NO: 4173 - RNA, 21 nt, Artificial Sequence
  source: /note="Description of Artificial Sequence: Synthetic oligonucleotide"
auuaugugaaacaaaccuuaa

SEQ ID NO: 4174 - RNA, 21 nt, Artificial Sequence
  source: /note="Description of Artificial Sequence: Synthetic oligonucleotide"
uuaugugaaacaaaccuuaca

SEQ ID NO: 4175 - RNA, 21 nt, Artificial Sequence
  source: /note="Description of Artificial Sequence: Synthetic oligonucleotide"
uaugugaaacaaaccuuacga

SEQ ID NO: 4176 - RNA, 21 nt, Artificial Sequence
  source: /note="Description of Artificial Sequence: Synthetic oligonucleotide"
uaugugaaacaaaccuuacga

SEQ ID NO: 4177 - RNA, 21 nt, Artificial Sequence
  source: /note="Description of Artificial Sequence: Synthetic oligonucleotide"
uaugugaaacaaacuuuacga

SEQ ID NO: 4178 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uaugugaaacaaaccuuacga

SEQ ID NO: 4179 - RNA, 21 nt, Artificial Sequence
  source: /note="Description of Artificial Sequence: Synthetic oligonucleotide"
uaugugaaacaaaccuuacga

SEQ ID NO: 4180 - RNA, 21 nt, Artificial Sequence
  source: /note="Description of Artificial Sequence: Synthetic oligonucleotide"
uaugugaaacaaaccuuacga

SEQ ID NO: 4181 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uaugugaaacaaaccuuacga

SEQ ID NO: 4182 - RNA, 21 nt, Artificial Sequence
  source: /note="Description of Artificial Sequence: Synthetic oligonucleotide"
augugaaacaaaccuuacgua

SEQ ID NO: 4183 - RNA, 21 nt, Artificial Sequence
  source: /note="Description of Artificial Sequence: Synthetic oligonucleotide"
augugaaacaaaccuuacgua

SEQ ID NO: 4184 - RNA, 21 nt, Artificial Sequence
  source: /note="Description of Artificial Sequence: Synthetic oligonucleotide"
augugaaacaaaccuuacgua

SEQ ID NO: 4185 - RNA, 21 nt, Artificial Sequence
  source: /note="Description of Artificial Sequence: Synthetic oligonucleotide"
augugaaacaaaccuuacgua

SEQ ID NO: 4186 - RNA, 21 nt, Artificial Sequence
  source: /note="Description of Artificial Sequence: Synthetic oligonucleotide"
augugaaacaaaccuuacgua

SEQ ID NO: 4187 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
augugaaacaaaccuuacgua

SEQ ID NO: 4188 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
augugaaacaaaccuuacgua

SEQ ID NO: 4189 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
augugaaacaaaccuuacgua

SEQ ID NO: 4190 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugugaaacaaaccuuacguga

SEQ ID NO: 4191 - RNA, 19 nt, Artificial Sequence
  source: /note="Description of Artificial Sequence: Synthetic oligonucleotide"
gugaaacaaaccuuacgua

SEQ ID NO: 4192 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gugaaacaaaccuuacgugaa

SEQ ID NO: 4193 - RNA, 21 nt, Artificial Sequence
  source: /note="Description of Artificial Sequence: Synthetic oligonucleotide"
gugaaacaaaccuuacgugaa

SEQ ID NO: 4194 - RNA, 21 nt, Artificial Sequence
  source: /note="Description of Artificial Sequence: Synthetic oligonucleotide"
ugaaacaaaccuuacgugaaa

SEQ ID NO: 4195 - RNA, 21 nt, Artificial Sequence
  source: /note="Description of Artificial Sequence: Synthetic oligonucleotide"
gaaacaaaccuuacgugaaua

SEQ ID NO: 4196 - RNA, 21 nt, Artificial Sequence
  source: /note="Description of Artificial Sequence: Synthetic oligonucleotide"
gaaacaaaccuuacgugaaua

SEQ ID NO: 4197 - RNA, 21 nt, Artificial Sequence
  source: /note="Description of Artificial Sequence: Synthetic oligonucleotide"
aaacaaaccuuacgugaauua

SEQ ID NO: 4198 - RNA, 21 nt, Artificial Sequence
  source: /note="Description of Artificial Sequence: Synthetic oligonucleotide"
ugugauauauuuuacaacaua

SEQ ID NO: 4199 - RNA, 21 nt, Artificial Sequence
  source: /note="Description of Artificial Sequence: Synthetic oligonucleotide"
ugugauauauuuuacaacaua

SEQ ID NO: 4200 - RNA, 21 nt, Artificial Sequence
  source: /note="Description of Artificial Sequence: Synthetic oligonucleotide"
gugauauauuuuacaacauca

SEQ ID NO: 4201 - RNA, 21 nt, Artificial Sequence
  source: /note="Description of Artificial Sequence: Synthetic oligonucleotide"
ugauauauuuuacaacaucca

SEQ ID NO: 4202 - RNA, 21 nt, Artificial Sequence
  source: /note="Description of Artificial Sequence: Synthetic oligonucleotide"
gauauauuuuacaacauccga

SEQ ID NO: 4203 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gauauauuuuacaacauccga

SEQ ID NO: 4204 - RNA, 21 nt, Artificial Sequence
  source: /note="Description of Artificial Sequence: Synthetic oligonucleotide"
auauauuuuacaacauccgua

SEQ ID NO: 4205 - RNA, 21 nt, Artificial Sequence
  source: /note="Description of Artificial Sequence: Synthetic oligonucleotide"
auauauuuuacaacauccgua

SEQ ID NO: 4206 - RNA, 21 nt, Artificial Sequence
  source: /note="Description of Artificial Sequence: Synthetic oligonucleotide"
uauauuuuacaacauccguua

SEQ ID NO: 4207 - RNA, 21 nt, Artificial Sequence
  source: /note="Description of Artificial Sequence: Synthetic oligonucleotide"
uauauuuuacaacauccguua

SEQ ID NO: 4208 - RNA, 21 nt, Artificial Sequence
  source: /note="Description of Artificial Sequence: Synthetic oligonucleotide"
uauauuuuacaacauccguua

SEQ ID NO: 4209 - RNA, 21 nt, Artificial Sequence
  source: /note="Description of Artificial Sequence: Synthetic oligonucleotide"
uauauuuuacaacauccguua

SEQ ID NO: 4210 - RNA, 21 nt, Artificial Sequence
  source: /note="Description of Artificial Sequence: Synthetic oligonucleotide"
uauauuuuacaacauccguua

SEQ ID NO: 4211 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uauauuuuacaacauccguua

SEQ ID NO: 4212 - RNA, 21 nt, Artificial Sequence
  source: /note="Description of Artificial Sequence: Synthetic oligonucleotide"
uauauuuuacaacauccguua

SEQ ID NO: 4213 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uauauuuuacaacauccguua

SEQ ID NO: 4214 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uauauuuuacaacauccguua

SEQ ID NO: 4215 - RNA, 21 nt, Artificial Sequence
  source: /note="Description of Artificial Sequence: Synthetic oligonucleotide"
auauuuuacaacauccguuaa

SEQ ID NO: 4216 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auauuuuacaacauccguuaa

SEQ ID NO: 4217 - RNA, 19 nt, Artificial Sequence
  source: /note="Description of Artificial Sequence: Synthetic oligonucleotide"
uauuuuacaacauccguua

SEQ ID NO: 4218 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uauuuuacaacauccguuaua

SEQ ID NO: 4219 - RNA, 19 nt, Artificial Sequence
  source: /note="Description of Artificial Sequence: Synthetic oligonucleotide"
uauuuuacaacauccguua

SEQ ID NO: 4220 - RNA, 21 nt, Artificial Sequence
  source: /note="Description of Artificial Sequence: Synthetic oligonucleotide"
auuuuacaacauccguuauua

SEQ ID NO: 4221 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auuuuacaacauccguuauua

SEQ ID NO: 4222 - RNA, 21 nt, Artificial Sequence
  source: /note="Description of Artificial Sequence: Synthetic oligonucleotide"
uuuuacaacauccguuauuaa

SEQ ID NO: 4223 - RNA, 21 nt, Artificial Sequence
  source: /note="Description of Artificial Sequence: Synthetic oligonucleotide"
uuuacaacauccguuauuaca

SEQ ID NO: 4224 - RNA, 21 nt, Artificial Sequence
  source: /note="Description of Artificial Sequence: Synthetic oligonucleotide"
caacacaauuucuucuuagca

SEQ ID NO: 4225 - RNA, 21 nt, Artificial Sequence
  source: /note="Description of Artificial Sequence: Synthetic oligonucleotide"
caacacaauuucuucuuagca

SEQ ID NO: 4226 - RNA, 21 nt, Artificial Sequence
  source: /note="Description of Artificial Sequence: Synthetic oligonucleotide"
caacacaauuucuucuuagca

SEQ ID NO: 4227 - RNA, 21 nt, Artificial Sequence
  source: /note="Description of Artificial Sequence: Synthetic oligonucleotide"
caacacaauuucuucuuagca

SEQ ID NO: 4228 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
caacacaatutcuucuuagca

SEQ ID NO: 4229 - RNA, 19 nt, Artificial Sequence
  source: /note="Description of Artificial Sequence: Synthetic oligonucleotide"
acacaauuucuucuuagca

SEQ ID NO: 4230 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ggcuucaaguguuccuacuga

SEQ ID NO: 4231 - RNA, 21 nt, Artificial Sequence
  source: /note="Description of Artificial Sequence: Synthetic oligonucleotide"
gcuucaaguguuccuacugua

SEQ ID NO: 4232 - RNA, 21 nt, Artificial Sequence
  source: /note="Description of Artificial Sequence: Synthetic oligonucleotide"
cuucaaguguuccuacuguca

SEQ ID NO: 4233 - RNA, 21 nt, Artificial Sequence
  source: /note="Description of Artificial Sequence: Synthetic oligonucleotide"
uucaaguguuccuacugucaa

SEQ ID NO: 4234 - RNA, 21 nt, Artificial Sequence
  source: /note="Description of Artificial Sequence: Synthetic oligonucleotide"
uucaaguguuccuacugucaa

SEQ ID NO: 4235 - RNA, 21 nt, Artificial Sequence
  source: /note="Description of Artificial Sequence: Synthetic oligonucleotide"
ucaaguguuccuacugucaua

SEQ ID NO: 4236 - RNA, 21 nt, Artificial Sequence
  source: /note="Description of Artificial Sequence: Synthetic oligonucleotide"
ucaaguguuccuacugucaua

SEQ ID NO: 4237 - RNA, 21 nt, Artificial Sequence
  source: /note="Description of Artificial Sequence: Synthetic oligonucleotide"
caaguguuccuacugucauga

SEQ ID NO: 4238 - RNA, 21 nt, Artificial Sequence
  source: /note="Description of Artificial Sequence: Synthetic oligonucleotide"
caaguguuccuacugucauga

SEQ ID NO: 4239 - RNA, 21 nt, Artificial Sequence
  source: /note="Description of Artificial Sequence: Synthetic oligonucleotide"
caaguguuccuacugucauga

SEQ ID NO: 4240 - RNA, 21 nt, Artificial Sequence
  source: /note="Description of Artificial Sequence: Synthetic oligonucleotide"
caaguguuccuacugucauga

SEQ ID NO: 4241 - RNA, 21 nt, Artificial Sequence
  source: /note="Description of Artificial Sequence: Synthetic oligonucleotide"
caaguguuccuacugucauga

SEQ ID NO: 4242 - RNA, 21 nt, Artificial Sequence
  source: /note="Description of Artificial Sequence: Synthetic oligonucleotide"
caaguguuccuacugucauga

SEQ ID NO: 4243 - RNA, 21 nt, Artificial Sequence
  source: /note="Description of Artificial Sequence: Synthetic oligonucleotide"
caaguguuccuacugucauga

SEQ ID NO: 4244 - RNA, 21 nt, Artificial Sequence
  source: /note="Description of Artificial Sequence: Synthetic oligonucleotide"
caaguguuccuacugucauga

SEQ ID NO: 4245 - RNA, 21 nt, Artificial Sequence
  source: /note="Description of Artificial Sequence: Synthetic oligonucleotide"
caaguguuccuacugucauga

SEQ ID NO: 4246 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaguguuccuacugucaugaa

SEQ ID NO: 4247 - RNA, 19 nt, Artificial Sequence
  source: /note="Description of Artificial Sequence: Synthetic oligonucleotide"
aguguuccuacugucauga

SEQ ID NO: 4248 - RNA, 19 nt, Artificial Sequence
  source: /note="Description of Artificial Sequence: Synthetic oligonucleotide"
aguguuccuacugucauga

SEQ ID NO: 4249 - RNA, 21 nt, Artificial Sequence
  source: /note="Description of Artificial Sequence: Synthetic oligonucleotide"
aguguuccuacugucaugaca

SEQ ID NO: 4250 - RNA, 21 nt, Artificial Sequence
  source: /note="Description of Artificial Sequence: Synthetic oligonucleotide"
guguuccuacugucaugacca

SEQ ID NO: 4251 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uguuccuacugucaugaccua

SEQ ID NO: 4252 - RNA, 21 nt, Artificial Sequence
  source: /note="Description of Artificial Sequence: Synthetic oligonucleotide"
guuccuacugucaugaccuga

SEQ ID NO: 4253 - RNA, 21 nt, Artificial Sequence
  source: /note="Description of Artificial Sequence: Synthetic oligonucleotide"
uugauaguuaccuaguuugca

SEQ ID NO: 4254 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uugauagutaccuaguuugca

SEQ ID NO: 4255 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uugauagutaccuaguuugca

SEQ ID NO: 4256 - RNA, 21 nt, Artificial Sequence
  source: /note="Description of Artificial Sequence: Synthetic oligonucleotide"
uugauaguuaccuaguuugca

SEQ ID NO: 4257 - RNA, 21 nt, Artificial Sequence
  source: /note="Description of Artificial Sequence: Synthetic oligonucleotide"
uugauaguuaccuaguuugca

SEQ ID NO: 4258 - RNA, 21 nt, Artificial Sequence
  source: /note="Description of Artificial Sequence: Synthetic oligonucleotide"
uugauaguuaccuaguuugca

SEQ ID NO: 4259 - RNA, 21 nt, Artificial Sequence
  source: /note="Description of Artificial Sequence: Synthetic oligonucleotide"
uugauaguuaccuaguuugca

SEQ ID NO: 4260 - RNA, 21 nt, Artificial Sequence
  source: /note="Description of Artificial Sequence: Synthetic oligonucleotide"
uugauaguuaccuaauuugca

SEQ ID NO: 4261 - RNA, 21 nt, Artificial Sequence
  source: /note="Description of Artificial Sequence: Synthetic oligonucleotide"
uugauaguuaccuaguuugca

SEQ ID NO: 4262 - RNA, 21 nt, Artificial Sequence
  source: /note="Description of Artificial Sequence: Synthetic oligonucleotide"
uugauaguuaccuaguuugca

SEQ ID NO: 4263 - DNA, 19 bp, Artificial Sequence
  source: /note="Description of Artificial Sequence: Synthetic oligonucleotide"
  source: /note="Description of Combined DNA/RNA Molecule: Synthetic oligonucleotide"
gauagutaccuaguuugca

SEQ ID NO: 4264 - RNA, 19 nt, Artificial Sequence
  source: /note="Description of Artificial Sequence: Synthetic oligonucleotide"
gauaguuaccuaguuugca

SEQ ID NO: 4265 - RNA, 19 nt, Artificial Sequence
  source: /note="Description of Artificial Sequence: Synthetic oligonucleotide"
gauaguuaccuaguuugca

SEQ ID NO: 4266 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uagatuguuuucccuuuguguuc

SEQ ID NO: 4267 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uaagautguuuucccuuuguguu

SEQ ID NO: 4268 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugaagatuguuuucccuuugugu

SEQ ID NO: 4269 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uggaagauuguuuucccuuugug

SEQ ID NO: 4270 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucggaagauuguuuucccuuugu

SEQ ID NO: 4271 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucggaagauugtuuucccuuugu

SEQ ID NO: 4272 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uacggaagauuguuutcccuuug

SEQ ID NO: 4273 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uacggaagauuguuutcccuuug

SEQ ID NO: 4274 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uacggaagauugututcccuuug

SEQ ID NO: 4275 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uacggaagauugututcccuuug

SEQ ID NO: 4276 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uacggaagauuguuutcccuuug

SEQ ID NO: 4277 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uacggaagauuguuutcccuuug

SEQ ID NO: 4278 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uacggaagauuguuutcccuuug

SEQ ID NO: 4279 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uacggaagauuguuutcccuuug

SEQ ID NO: 4280 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uacggaagauuguuutcccuucc

SEQ ID NO: 4281 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uacggaagauuguuutcccuuug

SEQ ID NO: 4282 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uaacggaagauuguuuucccuuu

SEQ ID NO: 4283 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uaacggaagautguuuucccuuu

SEQ ID NO: 4284 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uacggaagauuguuutcccuu

SEQ ID NO: 4285 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uacggaagauuguuutcccuu

SEQ ID NO: 4286 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uaaacggaagatuguuuucccuu

SEQ ID NO: 4287 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugaaacggaagauuguuuucccu

SEQ ID NO: 4288 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uugaaacggaagauuguuuuccc

SEQ ID NO: 4289 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uugaaatggaagauuguuuuccc

SEQ ID NO: 4290 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uuugaaacggaagauuguuuucc

SEQ ID NO: 4291 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uuugaaacggaagauuguuuucc

SEQ ID NO: 4292 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucagtaaaaguguacucgacauu

SEQ ID NO: 4293 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucagtaaaaguguacucgacacc

SEQ ID NO: 4294 - RNA, 23 nt, Artificial Sequence
  source: /note="Description of Artificial Sequence: Synthetic oligonucleotide"
ucaguaaaaguguacucgacauu

SEQ ID NO: 4295 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucagtaaaaguguactcgacauu

SEQ ID NO: 4296 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucagtaaaaguguacucgacacc

SEQ ID NO: 4297 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucagtaaaaguguactcgacacc

SEQ ID NO: 4298 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucagtaaaaguguactcgacauu

SEQ ID NO: 4299 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucagtaaaaguguactcgacauu

SEQ ID NO: 4300 - RNA, 23 nt, Artificial Sequence
  source: /note="Description of Artificial Sequence: Synthetic oligonucleotide"
ucaguaaaaguguacucgacauu

SEQ ID NO: 4301 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucagtaaaaguguacucgacacc

SEQ ID NO: 4302 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucagtaaaaguguactcgacauu

SEQ ID NO: 4303 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucagtaaaaguguactcgacauu

SEQ ID NO: 4304 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucagtaaaaguguacucgacacc

SEQ ID NO: 4305 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucagtaaaaguguactcgacauu

SEQ ID NO: 4306 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucagtaaaaguguacucgacauu

SEQ ID NO: 4307 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucagtaaaaguguactcgacacc

SEQ ID NO: 4308 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucagtaaaaguguactcgacacc

SEQ ID NO: 4309 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucagtaaaaguguactcgacauu

SEQ ID NO: 4310 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucagtaaaaguguacucgacg

SEQ ID NO: 4311 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucagtaaaaguguactcgacg

SEQ ID NO: 4312 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucagtaaaaguguactcgacg

SEQ ID NO: 4313 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uuuctccuacacagaagccucuu

SEQ ID NO: 4314 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uauucuccuacacagaagccucu

SEQ ID NO: 4315 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uaautctccuacacagaagccuc

SEQ ID NO: 4316 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugaatucuccuacacagaagccu

SEQ ID NO: 4317 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uugaautcucctacacagaagcc

SEQ ID NO: 4318 - RNA, 23 nt, Artificial Sequence
  source: /note="Description of Artificial Sequence: Synthetic oligonucleotide"
ugugaauucuccuacacagaagc

SEQ ID NO: 4319 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugugaatucuccuacacagaagc

SEQ ID NO: 4320 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugugaauucuccuacacagaagc

SEQ ID NO: 4321 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugugaatucuccuacacagaagc

SEQ ID NO: 4322 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugugaauucuccuacacagaagc

SEQ ID NO: 4323 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugugaatucuccuacacagaagc

SEQ ID NO: 4324 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugugaauucuccuacacagaauc

SEQ ID NO: 4325 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugugaatucuccuacacagaauc

SEQ ID NO: 4326 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uagugaauucuccuacacagagg

SEQ ID NO: 4327 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uaagtgaauuctccuacacaggg

SEQ ID NO: 4328 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uaaagugaauucuccuacacagg

SEQ ID NO: 4329 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uaaaagtgaautcuccuacacgg

SEQ ID NO: 4330 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugaaaagugaatucuccuacacg

SEQ ID NO: 4331 - RNA, 23 nt, Artificial Sequence
  source: /note="Description of Artificial Sequence: Synthetic oligonucleotide"
ugaaaagugaauucuccuacaca

SEQ ID NO: 4332 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugaaaagugaatucuccuacaca

SEQ ID NO: 4333 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugaaaagugaatucuccuacacg

SEQ ID NO: 4334 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugaaaaaugaatucuccuacacg

SEQ ID NO: 4335 - RNA, 23 nt, Artificial Sequence
  source: /note="Description of Artificial Sequence: Synthetic oligonucleotide"
ugaaaagugaauucuccuacaca

SEQ ID NO: 4336 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugaaaagugaauucuccuacg

SEQ ID NO: 4337 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugaaaagugaatucuccuacacg

SEQ ID NO: 4338 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugaaaaaugaauucuccuacacg

SEQ ID NO: 4339 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugaaaagugaatucuccuacacg

SEQ ID NO: 4340 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugaaaagugaatucuccuacacg

SEQ ID NO: 4341 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugaaaagugaatucuccuacacg

SEQ ID NO: 4342 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugaaaaaugaatucuccuacacg

SEQ ID NO: 4343 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugaaaagugaauucuccuacacg

SEQ ID NO: 4344 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugaaaagugaatucuccuacacg

SEQ ID NO: 4345 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugaaaagugaatucuccuacacg

SEQ ID NO: 4346 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugaaaagugaatucuccuacacg

SEQ ID NO: 4347 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uagaaaagugaauucuccuacgc

SEQ ID NO: 4348 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uagaaaagugaauucuccuacgc

SEQ ID NO: 4349 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uaagaaaagugaauucuccuacg

SEQ ID NO: 4350 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uaagaaaagugaauucuccuacg

SEQ ID NO: 4351 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugaaaagugaatucuccuacg

SEQ ID NO: 4352 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugaaaagugaatucuccuacg

SEQ ID NO: 4353 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugaagaaaagugaauucuccugc

SEQ ID NO: 4354 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucgaagaaaagugaauucuccug

SEQ ID NO: 4355 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucgaagaaaagtgaauucuccug

SEQ ID NO: 4356 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uacgaagaaaagugaauucuccu

SEQ ID NO: 4357 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugaaaacauuuaugcuucagguu

SEQ ID NO: 4358 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucgaaaacauuuaugcuucaggu

SEQ ID NO: 4359 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucgaaaacauuuaugcuucaggu

SEQ ID NO: 4360 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uucgaaaacautuaugcuucagg

SEQ ID NO: 4361 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uuucgaaaacatuuaugcuucag

SEQ ID NO: 4362 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uuucgaaaacauuuaugcuucag

SEQ ID NO: 4363 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uuuucgaaaacauuuaugcuucg

SEQ ID NO: 4364 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uauutcgaaaacauuuaugcuuc

SEQ ID NO: 4365 - RNA, 23 nt, Artificial Sequence
  source: /note="Description of Artificial Sequence: Synthetic oligonucleotide"
uauuucgaaaacauuuaugcuuc

SEQ ID NO: 4366 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uauutcgaaaacauuuaugcuuc

SEQ ID NO: 4367 - RNA, 23 nt, Artificial Sequence
  source: /note="Description of Artificial Sequence: Synthetic oligonucleotide"
uauuucgaaaacauuuaugcuuc

SEQ ID NO: 4368 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uauutcaaaaacauuuaugcuuc

SEQ ID NO: 4369 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uauutcgaaaacauuuaugcuuc

SEQ ID NO: 4370 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uauutcgaaaacauuuaugcucc

SEQ ID NO: 4371 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uauutcgaaaacauuuaugcuuc

SEQ ID NO: 4372 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uauutcgaaaacauuuaugcucc

SEQ ID NO: 4373 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uaautucgaaaacauuuaugcuu

SEQ ID NO: 4374 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugaatutcgaaaacauuuaugcu

SEQ ID NO: 4375 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uauutcgaaaacauuuaugcu

SEQ ID NO: 4376 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uugaautucgaaaacauuuaugc

SEQ ID NO: 4377 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uugaautucgaaaacauuuaugu

SEQ ID NO: 4378 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugugaatuucgaaaacauuuaug

SEQ ID NO: 4379 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uagugaauuucgaaaacauuugu

SEQ ID NO: 4380 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uacgacaaagaagaucauguagg

SEQ ID NO: 4381 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uacgacaaagaagaucauguacc

SEQ ID NO: 4382 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uuacgacaaagaagaucaugugg

SEQ ID NO: 4383 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucuacgacaaagaagaucaugug

SEQ ID NO: 4384 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucuacgacaaagaagaucaugug

SEQ ID NO: 4385 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucuacgacaaagaagaucaugua

SEQ ID NO: 4386 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucuacgacaaagaagaucaugug

SEQ ID NO: 4387 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucuacgacaaagaagaucaugug

SEQ ID NO: 4388 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucuacgacaaagaagaucaugcc

SEQ ID NO: 4389 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucuacgacaaagaagaucaugug

SEQ ID NO: 4390 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucuacgacaaagaagaucaugug

SEQ ID NO: 4391 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucuacgacaaagaagaucaugcc

SEQ ID NO: 4392 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucuacgacaaagaagaucaugug

SEQ ID NO: 4393 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucuacgacaaagaagaucaugug

SEQ ID NO: 4394 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uacuacgacaaagaagaucaugu

SEQ ID NO: 4395 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucuacgacaaagaagaucaug

SEQ ID NO: 4396 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucactacgacaaagaagaucaug

SEQ ID NO: 4397 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucuacgacaaagaagaucaug

SEQ ID NO: 4398 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uucacuacgacaaagaagaucgu

SEQ ID NO: 4399 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uucacuacgacaaagaagaucgu

SEQ ID NO: 4400 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uucacuacgacaaagaagaucgu

SEQ ID NO: 4401 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uucacuacgacaaagaagaucgu

SEQ ID NO: 4402 - RNA, 23 nt, Artificial Sequence
  source: /note="Description of Artificial Sequence: Synthetic oligonucleotide"
uucacuacgacaaagaagaucau

SEQ ID NO: 4403 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uucacuacgacaaagaagaucgu

SEQ ID NO: 4404 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uucacuacgacaaagaagaucgu

SEQ ID NO: 4405 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uucacuacgacaaagaagaucgu

SEQ ID NO: 4406 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uucacuacgacaaagaagaucgu

SEQ ID NO: 4407 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uucacuacgacaaagaagaucgu

SEQ ID NO: 4408 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uucacuacgacaaagaagaucgu

SEQ ID NO: 4409 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uucacuacgacaaagaagaucgu

SEQ ID NO: 4410 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uucacuacgacaaagaagaucgu

SEQ ID NO: 4411 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uaucactacgacaaagaagaucg

SEQ ID NO: 4412 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uucacuacgacaaagaagauc

SEQ ID NO: 4413 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uucacuacgacaaagaagauc

SEQ ID NO: 4414 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uaaucacuacgacaaagaagauc

SEQ ID NO: 4415 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uaaatcacuacgacaaagaaggu

SEQ ID NO: 4416 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uaaaaucacuacgacaaagaagg

SEQ ID NO: 4417 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugaaaatcacuacgacaaagagg

SEQ ID NO: 4418 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uugcaagaucuacaaaaggaucc

SEQ ID NO: 4419 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uuugcaagauctacaaaaggauc

SEQ ID NO: 4420 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uauugcaagaucuacaaaagggu

SEQ ID NO: 4421 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uaautgcaagaucuacaaaaggg

SEQ ID NO: 4422 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uuaatugcaagaucuacaaagcc

SEQ ID NO: 4423 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uuaatugcaagaucuacaaaagg

SEQ ID NO: 4424 - RNA, 23 nt, Artificial Sequence
  source: /note="Description of Artificial Sequence: Synthetic oligonucleotide"
uguaauugcaagaucuacaaagg

SEQ ID NO: 4425 - RNA, 23 nt, Artificial Sequence
  source: /note="Description of Artificial Sequence: Synthetic oligonucleotide"
uguaauugcaagaucuacaaaag

SEQ ID NO: 4426 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uguaautgcaagaucuacaaagg

SEQ ID NO: 4427 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uguaauugcaagaucuacaaagg

SEQ ID NO: 4428 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uguaautgcaagaucuacaaagg

SEQ ID NO: 4429 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uguaauugcaagaucuacaaagg

SEQ ID NO: 4430 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugguaauugcaagaucuacaagg

SEQ ID NO: 4431 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uuggtaauugcaagaucuacagg

SEQ ID NO: 4432 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uaugguaauugcaagaucuacgg

SEQ ID NO: 4433 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uaauggtaauugcaagaucuacg

SEQ ID NO: 4434 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uaaatgguaauugcaagaucugc

SEQ ID NO: 4435 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uaaatgguaautgcaagaucugc

SEQ ID NO: 4436 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uggutuguuucacauaauuuauu

SEQ ID NO: 4437 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uaagguuuguutcacauaauuug

SEQ ID NO: 4438 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uuaaggtuugutucacauaauuu

SEQ ID NO: 4439 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uuaaggtuuguuucacauaauuu

SEQ ID NO: 4440 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uguaagguuuguuucacauaauu

SEQ ID NO: 4441 - RNA, 23 nt, Artificial Sequence
  source: /note="Description of Artificial Sequence: Synthetic oligonucleotide"
ucguaagguuuguuucacauaau

SEQ ID NO: 4442 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucguaagguuuguuucacauagu

SEQ ID NO: 4443 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucguaaaguuuguuucacauagu

SEQ ID NO: 4444 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucguaagguuuguuucacauagu

SEQ ID NO: 4445 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucguaagguuuguuucacauagu

SEQ ID NO: 4446 - RNA, 23 nt, Artificial Sequence
  source: /note="Description of Artificial Sequence: Synthetic oligonucleotide"
ucguaagguuuguuucacauaau

SEQ ID NO: 4447 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucguaagguuuguuucacauagu

SEQ ID NO: 4448 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uacgtaagguuuguuucacaugg

SEQ ID NO: 4449 - RNA, 23 nt, Artificial Sequence
  source: /note="Description of Artificial Sequence: Synthetic oligonucleotide"
uacguaagguuuguuucacauaa

SEQ ID NO: 4450 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uacgtaagguuuguuucacaugg

SEQ ID NO: 4451 - RNA, 23 nt, Artificial Sequence
  source: /note="Description of Artificial Sequence: Synthetic oligonucleotide"
uacguaagguuuguuucacauaa

SEQ ID NO: 4452 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uacgtaagguuuguuucacaugg

SEQ ID NO: 4453 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uacgtaagguutguuucacaugg

SEQ ID NO: 4454 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uacgtaagguutguuucacaugg

SEQ ID NO: 4455 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uacgtaagguutguuucacaugg

SEQ ID NO: 4456 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucacguaaggutuguuucacaug

SEQ ID NO: 4457 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uacgtaagguuuguuucacgu

SEQ ID NO: 4458 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uucacgtaaggtuuguuucacgu

SEQ ID NO: 4459 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uucacgtaagguuuguuucacgu

SEQ ID NO: 4460 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uuucacguaagguuuguuucaca

SEQ ID NO: 4461 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uauucacguaagguuuguuucac

SEQ ID NO: 4462 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uauucacguaagguuuguuucac

SEQ ID NO: 4463 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uaautcacugaagguuuguuucg

SEQ ID NO: 4464 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uaugtuguaaaauauaucacagu

SEQ ID NO: 4465 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uaugtuguaaaauauaucacagu

SEQ ID NO: 4466 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugauguuguaaaauauaucacgg

SEQ ID NO: 4467 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uggatguuguaaaauauaucacg

SEQ ID NO: 4468 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucggauguuguaaaauauaucgc

SEQ ID NO: 4469 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucggauguuguaaaauauaucgc

SEQ ID NO: 4470 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uacggatguugtaaaauauaucg

SEQ ID NO: 4471 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uacggatguuguaaaauauaucg

SEQ ID NO: 4472 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uaacggauguuguaaaauauacc

SEQ ID NO: 4473 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uaacggauguuguaaaauauauc

SEQ ID NO: 4474 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uaacggauguuguaaaauauacc

SEQ ID NO: 4475 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uaacggauguuguaaaauauacc

SEQ ID NO: 4476 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uaacggauguuguaaaauauauc

SEQ ID NO: 4477 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uaacggauguuguaaaauauauc

SEQ ID NO: 4478 - RNA, 23 nt, Artificial Sequence
  source: /note="Description of Artificial Sequence: Synthetic oligonucleotide"
uaacggauguuguaaaauauauc

SEQ ID NO: 4479 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uaacggauguuguaaaauauauc

SEQ ID NO: 4480 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uaacggauguuguaaaauauauc

SEQ ID NO: 4481 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uuaacggauguuguaaaauaugu

SEQ ID NO: 4482 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uuaacggaugutguaaaauaugu

SEQ ID NO: 4483 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uaacggauguuguaaaauaug

SEQ ID NO: 4484 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uauaacggaugtuguaaaauaug

SEQ ID NO: 4485 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uaacggauguuguaaaauaug

SEQ ID NO: 4486 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uaauaacggauguuguaaaaugu

SEQ ID NO: 4487 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uaauaacggauguuguaaaaugu

SEQ ID NO: 4488 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uuaataacggatguuguaaaaug

SEQ ID NO: 4489 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uguaauaacggauguuguaaagu

SEQ ID NO: 4490 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugcuaagaagaaauuguguuguu

SEQ ID NO: 4491 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugcuaagaagaaauuguguuguu

SEQ ID NO: 4492 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugcuaagaagaaauuguguugcc

SEQ ID NO: 4493 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugcuaagaagaaauuguguugcc

SEQ ID NO: 4494 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugcuaagaagaaatuguguuguu

SEQ ID NO: 4495 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugcuaagaagaaauuguguug

SEQ ID NO: 4496 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucagtaggaacacuugaagccgg

SEQ ID NO: 4497 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uacaguaggaacacuugaagccg

SEQ ID NO: 4498 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugacagtaggaacacuugaagcc

SEQ ID NO: 4499 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uugacaguaggaacacuugaagc

SEQ ID NO: 4500 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uugacaguaggaacacuugaagc

SEQ ID NO: 4501 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uaugacaguaggaacacuugagg

SEQ ID NO: 4502 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uaugacaguaggaacacuugagg

SEQ ID NO: 4503 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucaugacaguaggaacacuugcc

SEQ ID NO: 4504 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucaugacaguaggaacacuuggg

SEQ ID NO: 4505 - RNA, 23 nt, Artificial Sequence
  source: /note="Description of Artificial Sequence: Synthetic oligonucleotide"
ucaugacaguaggaacacuugaa

SEQ ID NO: 4506 - RNA, 23 nt, Artificial Sequence
  source: /note="Description of Artificial Sequence: Synthetic oligonucleotide"
ucaugacaguaggaacacuugaa

SEQ ID NO: 4507 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucaugacaguaggaacacuuggg

SEQ ID NO: 4508 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucaugacaguaggaacacuuggg

SEQ ID NO: 4509 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucaugacaguaggaacacuuggg

SEQ ID NO: 4510 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucaugacaguaggaacacuugcc

SEQ ID NO: 4511 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucaugacaguaggaacacuuggg

SEQ ID NO: 4512 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uucatgacaguaggaacacuugg

SEQ ID NO: 4513 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucaugacaguaggaacacuug

SEQ ID NO: 4514 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucaugacaguaggaacacuug

SEQ ID NO: 4515 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugucaugacagtaggaacacuug

SEQ ID NO: 4516 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uggucatgacaguaggaacacuu

SEQ ID NO: 4517 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uaggtcaugacaguaggaacacu

SEQ ID NO: 4518 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucaggucaugacaguaggaacgc

SEQ ID NO: 4519 - RNA, 23 nt, Artificial Sequence
  source: /note="Description of Artificial Sequence: Synthetic oligonucleotide"
ugcaaacuagguaacuaucaaaa

SEQ ID NO: 4520 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugcaaacuaggtaacuaucaagg

SEQ ID NO: 4521 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugcaaacuaggtaacuaucaagg

SEQ ID NO: 4522 - RNA, 23 nt, Artificial Sequence
  source: /note="Description of Artificial Sequence: Synthetic oligonucleotide"
ugcaaacuagguaacuaucaaaa

SEQ ID NO: 4523 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugcaaacuagguaacuaucaagg

SEQ ID NO: 4524 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugcaaacuagguaacuaucaagg

SEQ ID NO: 4525 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugcaaacuaggtaacuaucaagg

SEQ ID NO: 4526 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugcaaatuagguaacuaucaagg

SEQ ID NO: 4527 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugcaaacuaggtaacuaucaagg

SEQ ID NO: 4528 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugcaaacuagguaacuaucaagg

SEQ ID NO: 4529 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugcaaacuaggtaacuaucgg

SEQ ID NO: 4530 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugcaaacuaggtaacuaucgg

SEQ ID NO: 4531 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugcaaacuagguaacuaucgg

SEQ ID NO: 4532-4533 - skipped (2 entries)

SEQ ID NO: 4534 - RNA, 23 nt, Homo sapiens
gaacaaagggaaaacaaucuucc

SEQ ID NO: 4535 - RNA, 23 nt, Homo sapiens
aacaaagggaaaacaaucuuccg

SEQ ID NO: 4536 - RNA, 23 nt, Homo sapiens
acaaagggaaaacaaucuuccgu

SEQ ID NO: 4537 - RNA, 23 nt, Homo sapiens
acaaagggaaaacaaucuuccgu

SEQ ID NO: 4538 - RNA, 23 nt, Homo sapiens
caaagggaaaacaaucuuccguu

SEQ ID NO: 4539 - RNA, 23 nt, Homo sapiens
caaagggaaaacaaucuuccguu

SEQ ID NO: 4540 - RNA, 23 nt, Homo sapiens
caaagggaaaacaaucuuccguu

SEQ ID NO: 4541 - RNA, 23 nt, Homo sapiens
caaagggaaaacaaucuuccguu

SEQ ID NO: 4542 - RNA, 23 nt, Homo sapiens
caaagggaaaacaaucuuccguu

SEQ ID NO: 4543 - RNA, 23 nt, Homo sapiens
caaagggaaaacaaucuuccguu

SEQ ID NO: 4544 - RNA, 23 nt, Homo sapiens
caaagggaaaacaaucuuccguu

SEQ ID NO: 4545 - RNA, 23 nt, Homo sapiens
caaagggaaaacaaucuuccguu

SEQ ID NO: 4546 - RNA, 23 nt, Homo sapiens
caaagggaaaacaaucuuccguu

SEQ ID NO: 4547 - RNA, 23 nt, Homo sapiens
caaagggaaaacaaucuuccguu

SEQ ID NO: 4548 - RNA, 23 nt, Homo sapiens
aaagggaaaacaaucuuccguuu

SEQ ID NO: 4549 - RNA, 23 nt, Homo sapiens
aaagggaaaacaaucuuccguuu

SEQ ID NO: 4550 - RNA, 21 nt, Homo sapiens
aagggaaaacaaucuuccguu

SEQ ID NO: 4551 - RNA, 21 nt, Homo sapiens
aagggaaaacaaucuuccguu

SEQ ID NO: 4552 - RNA, 23 nt, Homo sapiens
aagggaaaacaaucuuccguuuc

SEQ ID NO: 4553 - RNA, 23 nt, Homo sapiens
agggaaaacaaucuuccguuuca

SEQ ID NO: 4554 - RNA, 23 nt, Homo sapiens
gggaaaacaaucuuccguuucaa

SEQ ID NO: 4555 - RNA, 23 nt, Homo sapiens
gggaaaacaaucuuccguuucaa

SEQ ID NO: 4556 - RNA, 23 nt, Homo sapiens
ggaaaacaaucuuccguuucaau

SEQ ID NO: 4557 - RNA, 23 nt, Homo sapiens
ggaaaacaaucuuccguuucaau

SEQ ID NO: 4558 - RNA, 23 nt, Homo sapiens
aaugucgaguacacuuuuacugg

SEQ ID NO: 4559 - RNA, 23 nt, Homo sapiens
aaugucgaguacacuuuuacugg

SEQ ID NO: 4560 - RNA, 23 nt, Homo sapiens
aaugucgaguacacuuuuacugg

SEQ ID NO: 4561 - RNA, 23 nt, Homo sapiens
aaugucgaguacacuuuuacugg

SEQ ID NO: 4562 - RNA, 23 nt, Homo sapiens
aaugucgaguacacuuuuacugg

SEQ ID NO: 4563 - RNA, 23 nt, Homo sapiens
aaugucgaguacacuuuuacugg

SEQ ID NO: 4564 - RNA, 23 nt, Homo sapiens
aaugucgaguacacuuuuacugg

SEQ ID NO: 4565 - RNA, 23 nt, Homo sapiens
aaugucgaguacacuuuuacugg

SEQ ID NO: 4566 - RNA, 23 nt, Homo sapiens
aaugucgaguacacuuuuacugg

SEQ ID NO: 4567 - RNA, 23 nt, Homo sapiens
aaugucgaguacacuuuuacugg

SEQ ID NO: 4568 - RNA, 23 nt, Homo sapiens
aaugucgaguacacuuuuacugg

SEQ ID NO: 4569 - RNA, 23 nt, Homo sapiens
aaugucgaguacacuuuuacugg

SEQ ID NO: 4570 - RNA, 23 nt, Homo sapiens
aaugucgaguacacuuuuacugg

SEQ ID NO: 4571 - RNA, 23 nt, Homo sapiens
aaugucgaguacacuuuuacugg

SEQ ID NO: 4572 - RNA, 23 nt, Homo sapiens
aaugucgaguacacuuuuacugg

SEQ ID NO: 4573 - RNA, 23 nt, Homo sapiens
aaugucgaguacacuuuuacugg

SEQ ID NO: 4574 - RNA, 23 nt, Homo sapiens
aaugucgaguacacuuuuacugg

SEQ ID NO: 4575 - RNA, 23 nt, Homo sapiens
aaugucgaguacacuuuuacugg

SEQ ID NO: 4576 - RNA, 21 nt, Homo sapiens
ugucgaguacacuuuuacugg

SEQ ID NO: 4577 - RNA, 21 nt, Homo sapiens
ugucgaguacacuuuuacugg

SEQ ID NO: 4578 - RNA, 21 nt, Homo sapiens
ugucgaguacacuuuuacugg

SEQ ID NO: 4579 - RNA, 23 nt, Homo sapiens
aagaggcuucuguguaggagaau

SEQ ID NO: 4580 - RNA, 23 nt, Homo sapiens
agaggcuucuguguaggagaauu

SEQ ID NO: 4581 - RNA, 23 nt, Homo sapiens
gaggcuucuguguaggagaauuc

SEQ ID NO: 4582 - RNA, 23 nt, Homo sapiens
aggcuucuguguaggagaauuca

SEQ ID NO: 4583 - RNA, 23 nt, Homo sapiens
ggcuucuguguaggagaauucac

SEQ ID NO: 4584 - RNA, 23 nt, Homo sapiens
gcuucuguguaggagaauucacu

SEQ ID NO: 4585 - RNA, 23 nt, Homo sapiens
gcuucuguguaggagaauucacu

SEQ ID NO: 4586 - RNA, 23 nt, Homo sapiens
gcuucuguguaggagaauucacu

SEQ ID NO: 4587 - RNA, 23 nt, Homo sapiens
gcuucuguguaggagaauucacu

SEQ ID NO: 4588 - RNA, 23 nt, Homo sapiens
gcuucuguguaggagaauucacu

SEQ ID NO: 4589 - RNA, 23 nt, Homo sapiens
gcuucuguguaggagaauucacu

SEQ ID NO: 4590 - RNA, 23 nt, Homo sapiens
gcuucuguguaggagaauucacu

SEQ ID NO: 4591 - RNA, 23 nt, Homo sapiens
gcuucuguguaggagaauucacu

SEQ ID NO: 4592 - RNA, 23 nt, Homo sapiens
cuucuguguaggagaauucacuu

SEQ ID NO: 4593 - RNA, 23 nt, Homo sapiens
uucuguguaggagaauucacuuu

SEQ ID NO: 4594 - RNA, 23 nt, Homo sapiens
ucuguguaggagaauucacuuuu

SEQ ID NO: 4595 - RNA, 23 nt, Homo sapiens
cuguguaggagaauucacuuuuc

SEQ ID NO: 4596 - RNA, 23 nt, Homo sapiens
uguguaggagaauucacuuuucu

SEQ ID NO: 4597 - RNA, 23 nt, Homo sapiens
uguguaggagaauucacuuuucu

SEQ ID NO: 4598 - RNA, 23 nt, Homo sapiens
uguguaggagaauucacuuuucu

SEQ ID NO: 4599 - RNA, 23 nt, Homo sapiens
uguguaggagaauucacuuuucu

SEQ ID NO: 4600 - RNA, 23 nt, Homo sapiens
uguguaggagaauucacuuuucu

SEQ ID NO: 4601 - RNA, 23 nt, Homo sapiens
uguguaggagaauucacuuuucu

SEQ ID NO: 4602 - RNA, 21 nt, Homo sapiens
uguaggagaauucacuuuucu

SEQ ID NO: 4603 - RNA, 23 nt, Homo sapiens
uguguaggagaauucacuuuucu

SEQ ID NO: 4604 - RNA, 23 nt, Homo sapiens
uguguaggagaauucacuuuucu

SEQ ID NO: 4605 - RNA, 23 nt, Homo sapiens
uguguaggagaauucacuuuucu

SEQ ID NO: 4606 - RNA, 23 nt, Homo sapiens
uguguaggagaauucacuuuucu

SEQ ID NO: 4607 - RNA, 23 nt, Homo sapiens
uguguaggagaauucacuuuucu

SEQ ID NO: 4608 - RNA, 23 nt, Homo sapiens
uguguaggagaauucacuuuucu

SEQ ID NO: 4609 - RNA, 23 nt, Homo sapiens
uguguaggagaauucacuuuucu

SEQ ID NO: 4610 - RNA, 23 nt, Homo sapiens
uguguaggagaauucacuuuucu

SEQ ID NO: 4611 - RNA, 23 nt, Homo sapiens
uguguaggagaauucacuuuucu

SEQ ID NO: 4612 - RNA, 23 nt, Homo sapiens
uguguaggagaauucacuuuucu

SEQ ID NO: 4613 - RNA, 23 nt, Homo sapiens
guguaggagaauucacuuuucuu

SEQ ID NO: 4614 - RNA, 23 nt, Homo sapiens
guguaggagaauucacuuuucuu

SEQ ID NO: 4615 - RNA, 23 nt, Homo sapiens
uguaggagaauucacuuuucuuc

SEQ ID NO: 4616 - RNA, 23 nt, Homo sapiens
uguaggagaauucacuuuucuuc

SEQ ID NO: 4617 - RNA, 21 nt, Homo sapiens
uguaggagaauucacuuuucu

SEQ ID NO: 4618 - RNA, 21 nt, Homo sapiens
uguaggagaauucacuuuucu

SEQ ID NO: 4619 - RNA, 23 nt, Homo sapiens
guaggagaauucacuuuucuucg

SEQ ID NO: 4620 - RNA, 23 nt, Homo sapiens
uaggagaauucacuuuucuucgu

SEQ ID NO: 4621 - RNA, 23 nt, Homo sapiens
uaggagaauucacuuuucuucgu

SEQ ID NO: 4622 - RNA, 23 nt, Homo sapiens
aggagaauucacuuuucuucgug

SEQ ID NO: 4623 - RNA, 23 nt, Homo sapiens
aaccugaagcauaaauguuuucg

SEQ ID NO: 4624 - RNA, 23 nt, Homo sapiens
accugaagcauaaauguuuucga

SEQ ID NO: 4625 - RNA, 23 nt, Homo sapiens
accugaagcauaaauguuuucga

SEQ ID NO: 4626 - RNA, 23 nt, Homo sapiens
ccugaagcauaaauguuuucgaa

SEQ ID NO: 4627 - RNA, 23 nt, Homo sapiens
cugaagcauaaauguuuucgaaa

SEQ ID NO: 4628 - RNA, 23 nt, Homo sapiens
cugaagcauaaauguuuucgaaa

SEQ ID NO: 4629 - RNA, 23 nt, Homo sapiens
ugaagcauaaauguuuucgaaau

SEQ ID NO: 4630 - RNA, 23 nt, Homo sapiens
gaagcauaaauguuuucgaaauu

SEQ ID NO: 4631 - RNA, 23 nt, Homo sapiens
gaagcauaaauguuuucgaaauu

SEQ ID NO: 4632 - RNA, 23 nt, Homo sapiens
gaagcauaaauguuuucgaaauu

SEQ ID NO: 4633 - RNA, 23 nt, Homo sapiens
gaagcauaaauguuuucgaaauu

SEQ ID NO: 4634 - RNA, 23 nt, Homo sapiens
gaagcauaaauguuuucgaaauu

SEQ ID NO: 4635 - RNA, 23 nt, Homo sapiens
gaagcauaaauguuuucgaaauu

SEQ ID NO: 4636 - RNA, 23 nt, Homo sapiens
gaagcauaaauguuuucgaaauu

SEQ ID NO: 4637 - RNA, 23 nt, Homo sapiens
gaagcauaaauguuuucgaaauu

SEQ ID NO: 4638 - RNA, 23 nt, Homo sapiens
gaagcauaaauguuuucgaaauu

SEQ ID NO: 4639 - RNA, 23 nt, Homo sapiens
aagcauaaauguuuucgaaauuc

SEQ ID NO: 4640 - RNA, 23 nt, Homo sapiens
agcauaaauguuuucgaaauuca

SEQ ID NO: 4641 - RNA, 21 nt, Homo sapiens
agcauaaauguuuucgaaauu

SEQ ID NO: 4642 - RNA, 23 nt, Homo sapiens
gcauaaauguuuucgaaauucac

SEQ ID NO: 4643 - RNA, 23 nt, Homo sapiens
gcauaaauguuuucgaaauucac

SEQ ID NO: 4644 - RNA, 23 nt, Homo sapiens
cauaaauguuuucgaaauucacu

SEQ ID NO: 4645 - RNA, 23 nt, Homo sapiens
auaaauguuuucgaaauucacuu

SEQ ID NO: 4646 - RNA, 23 nt, Homo sapiens
ccuacaugaucuucuuugucgua

SEQ ID NO: 4647 - RNA, 23 nt, Homo sapiens
ccuacaugaucuucuuugucgua

SEQ ID NO: 4648 - RNA, 23 nt, Homo sapiens
cuacaugaucuucuuugucguag

SEQ ID NO: 4649 - RNA, 23 nt, Homo sapiens
uacaugaucuucuuugucguagu

SEQ ID NO: 4650 - RNA, 23 nt, Homo sapiens
uacaugaucuucuuugucguagu

SEQ ID NO: 4651 - RNA, 23 nt, Homo sapiens
uacaugaucuucuuugucguagu

SEQ ID NO: 4652 - RNA, 23 nt, Homo sapiens
uacaugaucuucuuugucguagu

SEQ ID NO: 4653 - RNA, 23 nt, Homo sapiens
uacaugaucuucuuugucguagu

SEQ ID NO: 4654 - RNA, 23 nt, Homo sapiens
uacaugaucuucuuugucguagu

SEQ ID NO: 4655 - RNA, 23 nt, Homo sapiens
uacaugaucuucuuugucguagu

SEQ ID NO: 4656 - RNA, 23 nt, Homo sapiens
uacaugaucuucuuugucguagu

SEQ ID NO: 4657 - RNA, 23 nt, Homo sapiens
uacaugaucuucuuugucguagu

SEQ ID NO: 4658 - RNA, 23 nt, Homo sapiens
uacaugaucuucuuugucguagu

SEQ ID NO: 4659 - RNA, 23 nt, Homo sapiens
uacaugaucuucuuugucguagu

SEQ ID NO: 4660 - RNA, 23 nt, Homo sapiens
acaugaucuucuuugucguagug

SEQ ID NO: 4661 - RNA, 21 nt, Homo sapiens
caugaucuucuuugucguagu

SEQ ID NO: 4662 - RNA, 23 nt, Homo sapiens
caugaucuucuuugucguaguga

SEQ ID NO: 4663 - RNA, 21 nt, Homo sapiens
caugaucuucuuugucguagu

SEQ ID NO: 4664 - RNA, 23 nt, Homo sapiens
augaucuucuuugucguagugau

SEQ ID NO: 4665 - RNA, 23 nt, Homo sapiens
augaucuucuuugucguagugau

SEQ ID NO: 4666 - RNA, 23 nt, Homo sapiens
augaucuucuuugucguagugau

SEQ ID NO: 4667 - RNA, 23 nt, Homo sapiens
augaucuucuuugucguagugau

SEQ ID NO: 4668 - RNA, 23 nt, Homo sapiens
augaucuucuuugucguagugau

SEQ ID NO: 4669 - RNA, 23 nt, Homo sapiens
augaucuucuuugucguagugau

SEQ ID NO: 4670 - RNA, 23 nt, Homo sapiens
augaucuucuuugucguagugau

SEQ ID NO: 4671 - RNA, 23 nt, Homo sapiens
augaucuucuuugucguagugau

SEQ ID NO: 4672 - RNA, 23 nt, Homo sapiens
augaucuucuuugucguagugau

SEQ ID NO: 4673 - RNA, 23 nt, Homo sapiens
augaucuucuuugucguagugau

SEQ ID NO: 4674 - RNA, 23 nt, Homo sapiens
augaucuucuuugucguagugau

SEQ ID NO: 4675 - RNA, 23 nt, Homo sapiens
augaucuucuuugucguagugau

SEQ ID NO: 4676 - RNA, 23 nt, Homo sapiens
augaucuucuuugucguagugau

SEQ ID NO: 4677 - RNA, 23 nt, Homo sapiens
ugaucuucuuugucguagugauu

SEQ ID NO: 4678 - RNA, 21 nt, Homo sapiens
gaucuucuuugucguagugau

SEQ ID NO: 4679 - RNA, 21 nt, Homo sapiens
gaucuucuuugucguagugau

SEQ ID NO: 4680 - RNA, 23 nt, Homo sapiens
gaucuucuuugucguagugauuu

SEQ ID NO: 4681 - RNA, 23 nt, Homo sapiens
aucuucuuugucguagugauuuu

SEQ ID NO: 4682 - RNA, 23 nt, Homo sapiens
ucuucuuugucguagugauuuuc

SEQ ID NO: 4683 - RNA, 23 nt, Homo sapiens
cuucuuugucguagugauuuucc

SEQ ID NO: 4684 - RNA, 23 nt, Homo sapiens
ggauccuuuuguagaucuugcaa

SEQ ID NO: 4685 - RNA, 23 nt, Homo sapiens
gauccuuuuguagaucuugcaau

SEQ ID NO: 4686 - RNA, 23 nt, Homo sapiens
auccuuuuguagaucuugcaauu

SEQ ID NO: 4687 - RNA, 23 nt, Homo sapiens
uccuuuuguagaucuugcaauua

SEQ ID NO: 4688 - skipped

SEQ ID NO: 4689 - RNA, 23 nt, Homo sapiens
ccuuuuguagaucuugcaauuac

SEQ ID NO: 4690 - RNA, 23 nt, Homo sapiens
cuuuuguagaucuugcaauuacc

SEQ ID NO: 4691 - RNA, 23 nt, Homo sapiens
cuuuuguagaucuugcaauuacc

SEQ ID NO: 4692 - RNA, 23 nt, Homo sapiens
cuuuuguagaucuugcaauuacc

SEQ ID NO: 4693 - RNA, 23 nt, Homo sapiens
cuuuuguagaucuugcaauuacc

SEQ ID NO: 4694 - RNA, 23 nt, Homo sapiens
cuuuuguagaucuugcaauuacc

SEQ ID NO: 4695 - RNA, 23 nt, Homo sapiens
cuuuuguagaucuugcaauuacc

SEQ ID NO: 4696 - RNA, 23 nt, Homo sapiens
uuuuguagaucuugcaauuacca

SEQ ID NO: 4697 - RNA, 23 nt, Homo sapiens
uuuguagaucuugcaauuaccau

SEQ ID NO: 4698 - RNA, 23 nt, Homo sapiens
uuguagaucuugcaauuaccauu

SEQ ID NO: 4699 - RNA, 23 nt, Homo sapiens
uguagaucuugcaauuaccauuu

SEQ ID NO: 4700 - RNA, 23 nt, Homo sapiens
guagaucuugcaauuaccauuug

SEQ ID NO: 4701 - RNA, 23 nt, Homo sapiens
guagaucuugcaauuaccauuug

SEQ ID NO: 4702 - RNA, 23 nt, Homo sapiens
aauaaauuaugugaaacaaaccu

SEQ ID NO: 4703 - RNA, 23 nt, Homo sapiens
uaaauuaugugaaacaaaccuua

SEQ ID NO: 4704 - RNA, 23 nt, Homo sapiens
aaauuaugugaaacaaaccuuac

SEQ ID NO: 4705 - RNA, 23 nt, Homo sapiens
aaauuaugugaaacaaaccuuac

SEQ ID NO: 4706 - RNA, 23 nt, Homo sapiens
aauuaugugaaacaaaccuuacg

SEQ ID NO: 4707 - RNA, 23 nt, Homo sapiens
auuaugugaaacaaaccuuacgu

SEQ ID NO: 4708 - RNA, 23 nt, Homo sapiens
auuaugugaaacaaaccuuacgu

SEQ ID NO: 4709 - RNA, 23 nt, Homo sapiens
auuaugugaaacaaaccuuacgu

SEQ ID NO: 4710 - RNA, 23 nt, Homo sapiens
auuaugugaaacaaaccuuacgu

SEQ ID NO: 4711 - RNA, 23 nt, Homo sapiens
auuaugugaaacaaaccuuacgu

SEQ ID NO: 4712 - RNA, 23 nt, Homo sapiens
auuaugugaaacaaaccuuacgu

SEQ ID NO: 4713 - RNA, 23 nt, Homo sapiens
auuaugugaaacaaaccuuacgu

SEQ ID NO: 4714 - RNA, 23 nt, Homo sapiens
uuaugugaaacaaaccuuacgug

SEQ ID NO: 4715 - RNA, 23 nt, Homo sapiens
uuaugugaaacaaaccuuacgug

SEQ ID NO: 4716 - RNA, 23 nt, Homo sapiens
uuaugugaaacaaaccuuacgug

SEQ ID NO: 4717 - RNA, 23 nt, Homo sapiens
uuaugugaaacaaaccuuacgug

SEQ ID NO: 4718 - RNA, 23 nt, Homo sapiens
uuaugugaaacaaaccuuacgug

SEQ ID NO: 4719 - RNA, 23 nt, Homo sapiens
uuaugugaaacaaaccuuacgug

SEQ ID NO: 4720 - RNA, 23 nt, Homo sapiens
uuaugugaaacaaaccuuacgug

SEQ ID NO: 4721 - RNA, 23 nt, Homo sapiens
uuaugugaaacaaaccuuacgug

SEQ ID NO: 4722 - RNA, 23 nt, Homo sapiens
uaugugaaacaaaccuuacguga

SEQ ID NO: 4723 - RNA, 21 nt, Homo sapiens
augugaaacaaaccuuacgug

SEQ ID NO: 4724 - RNA, 23 nt, Homo sapiens
augugaaacaaaccuuacgugaa

SEQ ID NO: 4725 - RNA, 23 nt, Homo sapiens
augugaaacaaaccuuacgugaa

SEQ ID NO: 4726 - RNA, 23 nt, Homo sapiens
ugugaaacaaaccuuacgugaau

SEQ ID NO: 4727 - RNA, 23 nt, Homo sapiens
gugaaacaaaccuuacgugaauu

SEQ ID NO: 4728 - RNA, 23 nt, Homo sapiens
gugaaacaaaccuuacgugaauu

SEQ ID NO: 4729 - skipped

SEQ ID NO: 4730 - RNA, 23 nt, Homo sapiens
auugugauauauuuuacaacauc

SEQ ID NO: 4731 - RNA, 23 nt, Homo sapiens
auugugauauauuuuacaacauc

SEQ ID NO: 4732 - RNA, 23 nt, Homo sapiens
uugugauauauuuuacaacaucc

SEQ ID NO: 4733 - RNA, 23 nt, Homo sapiens
ugugauauauuuuacaacauccg

SEQ ID NO: 4734 - RNA, 23 nt, Homo sapiens
gugauauauuuuacaacauccgu

SEQ ID NO: 4735 - RNA, 23 nt, Homo sapiens
gugauauauuuuacaacauccgu

SEQ ID NO: 4736 - RNA, 23 nt, Homo sapiens
ugauauauuuuacaacauccguu

SEQ ID NO: 4737 - RNA, 23 nt, Homo sapiens
ugauauauuuuacaacauccguu

SEQ ID NO: 4738 - RNA, 23 nt, Homo sapiens
gauauauuuuacaacauccguua

SEQ ID NO: 4739 - RNA, 23 nt, Homo sapiens
gauauauuuuacaacauccguua

SEQ ID NO: 4740 - RNA, 23 nt, Homo sapiens
gauauauuuuacaacauccguua

SEQ ID NO: 4741 - RNA, 23 nt, Homo sapiens
gauauauuuuacaacauccguua

SEQ ID NO: 4742 - RNA, 23 nt, Homo sapiens
gauauauuuuacaacauccguua

SEQ ID NO: 4743 - RNA, 23 nt, Homo sapiens
gauauauuuuacaacauccguua

SEQ ID NO: 4744 - RNA, 23 nt, Homo sapiens
gauauauuuuacaacauccguua

SEQ ID NO: 4745 - RNA, 23 nt, Homo sapiens
gauauauuuuacaacauccguua

SEQ ID NO: 4746 - RNA, 23 nt, Homo sapiens
gauauauuuuacaacauccguua

SEQ ID NO: 4747 - RNA, 23 nt, Homo sapiens
auauauuuuacaacauccguuau

SEQ ID NO: 4748 - RNA, 23 nt, Homo sapiens
auauauuuuacaacauccguuau

SEQ ID NO: 4749 - RNA, 21 nt, Homo sapiens
uauauuuuacaacauccguua

SEQ ID NO: 4750 - RNA, 23 nt, Homo sapiens
uauauuuuacaacauccguuauu

SEQ ID NO: 4751 - RNA, 21 nt, Homo sapiens
uauauuuuacaacauccguua

SEQ ID NO: 4752 - RNA, 23 nt, Homo sapiens
auauuuuacaacauccguuauua

SEQ ID NO: 4753 - RNA, 23 nt, Homo sapiens
auauuuuacaacauccguuauua

SEQ ID NO: 4754 - RNA, 23 nt, Homo sapiens
uauuuuacaacauccguuauuac

SEQ ID NO: 4755 - RNA, 23 nt, Homo sapiens
auuuuacaacauccguuauuacu

SEQ ID NO: 4756 - RNA, 23 nt, Homo sapiens
aacaacacaauuucuucuuagca

SEQ ID NO: 4757 - RNA, 23 nt, Homo sapiens
aacaacacaauuucuucuuagca

SEQ ID NO: 4758 - RNA, 23 nt, Homo sapiens
aacaacacaauuucuucuuagca

SEQ ID NO: 4759 - RNA, 23 nt, Homo sapiens
aacaacacaauuucuucuuagca

SEQ ID NO: 4760 - RNA, 23 nt, Homo sapiens
aacaacacaauuucuucuuagca

SEQ ID NO: 4761 - RNA, 21 nt, Homo sapiens
caacacaauuucuucuuagca

SEQ ID NO: 4762 - RNA, 23 nt, Homo sapiens
cuggcuucaaguguuccuacugu

SEQ ID NO: 4763 - RNA, 23 nt, Homo sapiens
uggcuucaaguguuccuacuguc

SEQ ID NO: 4764 - RNA, 23 nt, Homo sapiens
ggcuucaaguguuccuacuguca

SEQ ID NO: 4765 - RNA, 23 nt, Homo sapiens
gcuucaaguguuccuacugucau

SEQ ID NO: 4766 - RNA, 23 nt, Homo sapiens
gcuucaaguguuccuacugucau

SEQ ID NO: 4767 - RNA, 23 nt, Homo sapiens
cuucaaguguuccuacugucaug

SEQ ID NO: 4768 - RNA, 23 nt, Homo sapiens
cuucaaguguuccuacugucaug

SEQ ID NO: 4769 - RNA, 23 nt, Homo sapiens
uucaaguguuccuacugucauga

SEQ ID NO: 4770 - RNA, 23 nt, Homo sapiens
uucaaguguuccuacugucauga

SEQ ID NO: 4771 - RNA, 23 nt, Homo sapiens
uucaaguguuccuacugucauga

SEQ ID NO: 4772 - RNA, 23 nt, Homo sapiens
uucaaguguuccuacugucauga

SEQ ID NO: 4773 - RNA, 23 nt, Homo sapiens
uucaaguguuccuacugucauga

SEQ ID NO: 4774 - RNA, 23 nt, Homo sapiens
uucaaguguuccuacugucauga

SEQ ID NO: 4775 - RNA, 23 nt, Homo sapiens
uucaaguguuccuacugucauga

SEQ ID NO: 4776 - RNA, 23 nt, Homo sapiens
uucaaguguuccuacugucauga

SEQ ID NO: 4777 - RNA, 23 nt, Homo sapiens
uucaaguguuccuacugucauga

SEQ ID NO: 4778 - RNA, 23 nt, Homo sapiens
ucaaguguuccuacugucaugac

SEQ ID NO: 4779 - RNA, 21 nt, Homo sapiens
caaguguuccuacugucauga

SEQ ID NO: 4780 - RNA, 21 nt, Homo sapiens
caaguguuccuacugucauga

SEQ ID NO: 4781 - RNA, 23 nt, Homo sapiens
caaguguuccuacugucaugacc

SEQ ID NO: 4782 - RNA, 23 nt, Homo sapiens
aaguguuccuacugucaugaccu

SEQ ID NO: 4783 - RNA, 23 nt, Homo sapiens
aguguuccuacugucaugaccug

SEQ ID NO: 4784 - RNA, 23 nt, Homo sapiens
guguuccuacugucaugaccugc

SEQ ID NO: 4785 - RNA, 23 nt, Homo sapiens
uuuugauaguuaccuaguuugca

SEQ ID NO: 4786 - RNA, 23 nt, Homo sapiens
uuuugauaguuaccuaguuugca

SEQ ID NO: 4787 - RNA, 23 nt, Homo sapiens
uuuugauaguuaccuaguuugca

SEQ ID NO: 4788 - RNA, 23 nt, Homo sapiens
uuuugauaguuaccuaguuugca

SEQ ID NO: 4789 - RNA, 23 nt, Homo sapiens
uuuugauaguuaccuaguuugca

SEQ ID NO: 4790 - RNA, 23 nt, Homo sapiens
uuuugauaguuaccuaguuugca

SEQ ID NO: 4791 - RNA, 23 nt, Homo sapiens
uuuugauaguuaccuaguuugca

SEQ ID NO: 4792 - skipped

SEQ ID NO: 4793 - RNA, 23 nt, Homo sapiens
uuuugauaguuaccuaguuugca

SEQ ID NO: 4794 - RNA, 23 nt, Homo sapiens
uuuugauaguuaccuaguuugca

SEQ ID NO: 4795 - RNA, 21 nt, Homo sapiens
uugauaguuaccuaguuugca

SEQ ID NO: 4796 - RNA, 21 nt, Homo sapiens
uugauaguuaccuaguuugca

SEQ ID NO: 4797 - RNA, 21 nt, Homo sapiens
uugauaguuaccuaguuugca

SEQ ID NO: 4798 - RNA, 21 nt, Artificial Sequence
  source: /note="Description of Artificial Sequence: Synthetic oligonucleotide"
acacaaagggaaaacaaucua

SEQ ID NO: 4799 - RNA, 21 nt, Artificial Sequence
  source: /note="Description of Artificial Sequence: Synthetic oligonucleotide"
cacaaagggaaaacaaucuua

SEQ ID NO: 4800 - RNA, 21 nt, Artificial Sequence
  source: /note="Description of Artificial Sequence: Synthetic oligonucleotide"
acaaagggaaaacaaucuuca

SEQ ID NO: 4801 - RNA, 21 nt, Artificial Sequence
  source: /note="Description of Artificial Sequence: Synthetic oligonucleotide"
caaagggaaaacaaucuucca

SEQ ID NO: 4802 - RNA, 21 nt, Artificial Sequence
  source: /note="Description of Artificial Sequence: Synthetic oligonucleotide"
aaagggaaaacaaucuuccga

SEQ ID NO: 4803 - RNA, 21 nt, Artificial Sequence
  source: /note="Description of Artificial Sequence: Synthetic oligonucleotide"
aaagggaaaacaaucuuccga

SEQ ID NO: 4804 - RNA, 21 nt, Artificial Sequence
  source: /note="Description of Artificial Sequence: Synthetic oligonucleotide"
aagggaaaacaaucuuccgua

SEQ ID NO: 4805 - RNA, 21 nt, Artificial Sequence
  source: /note="Description of Artificial Sequence: Synthetic oligonucleotide"
aagggaaaacaaucuuccgua

SEQ ID NO: 4806 - RNA, 21 nt, Artificial Sequence
  source: /note="Description of Artificial Sequence: Synthetic oligonucleotide"
aagggaaaacaaucuuccgua

SEQ ID NO: 4807 - RNA, 21 nt, Artificial Sequence
  source: /note="Description of Artificial Sequence: Synthetic oligonucleotide"
aagggaaaacaaucuuccgua

SEQ ID NO: 4808 - RNA, 21 nt, Artificial Sequence
  source: /note="Description of Artificial Sequence: Synthetic oligonucleotide"
aagggaaaacaaucuuccgua

SEQ ID NO: 4809 - RNA, 21 nt, Artificial Sequence
  source: /note="Description of Artificial Sequence: Synthetic oligonucleotide"
aagggaaaacaaucuuccgua

SEQ ID NO: 4810 - RNA, 21 nt, Artificial Sequence
  source: /note="Description of Artificial Sequence: Synthetic oligonucleotide"
aagggaaaacaaucuuccgua

SEQ ID NO: 4811 - RNA, 21 nt, Artificial Sequence
  source: /note="Description of Artificial Sequence: Synthetic oligonucleotide"
aagggaaaacaaucuuccgua

SEQ ID NO: 4812 - RNA, 21 nt, Artificial Sequence
  source: /note="Description of Artificial Sequence: Synthetic oligonucleotide"
aagggaaaacaaucuuccgua

SEQ ID NO: 4813 - RNA, 21 nt, Artificial Sequence
  source: /note="Description of Artificial Sequence: Synthetic oligonucleotide"
aagggaaaacaaucuuccgua

SEQ ID NO: 4814 - RNA, 21 nt, Artificial Sequence
  source: /note="Description of Artificial Sequence: Synthetic oligonucleotide"
agggaaaacaaucuuccguua

SEQ ID NO: 4815 - RNA, 21 nt, Artificial Sequence
  source: /note="Description of Artificial Sequence: Synthetic oligonucleotide"
agggaaaacaaucuuccguua

SEQ ID NO: 4816 - RNA, 19 nt, Artificial Sequence
  source: /note="Description of Artificial Sequence: Synthetic oligonucleotide"
gggaaaacaaucuuccgua

SEQ ID NO: 4817 - RNA, 19 nt, Artificial Sequence
  source: /note="Description of Artificial Sequence: Synthetic oligonucleotide"
gggaaaacaaucuuccgua

SEQ ID NO: 4818 - RNA, 21 nt, Artificial Sequence
  source: /note="Description of Artificial Sequence: Synthetic oligonucleotide"
gggaaaacaaucuuccguuua

SEQ ID NO: 4819 - RNA, 21 nt, Artificial Sequence
  source: /note="Description of Artificial Sequence: Synthetic oligonucleotide"
ggaaaacaaucuuccguuuca

SEQ ID NO: 4820 - RNA, 21 nt, Artificial Sequence
  source: /note="Description of Artificial Sequence: Synthetic oligonucleotide"
gaaaacaaucuuccguuucaa

SEQ ID NO: 4821 - RNA, 21 nt, Artificial Sequence
  source: /note="Description of Artificial Sequence: Synthetic oligonucleotide"
gaaaacaaucuuccauuucaa

SEQ ID NO: 4822 - RNA, 21 nt, Artificial Sequence
  source: /note="Description of Artificial Sequence: Synthetic oligonucleotide"
aaaacaaucuuccguuucaaa

SEQ ID NO: 4823 - RNA, 21 nt, Artificial Sequence
  source: /note="Description of Artificial Sequence: Synthetic oligonucleotide"
aaaacaaucuuccguuucaaa

SEQ ID NO: 4824 - RNA, 21 nt, Artificial Sequence
  source: /note="Description of Artificial Sequence: Synthetic oligonucleotide"
ugucgaguacacuuuuacuga

SEQ ID NO: 4825 - RNA, 21 nt, Artificial Sequence
  source: /note="Description of Artificial Sequence: Synthetic oligonucleotide"
ugucgaguacacuuuuacuga

SEQ ID NO: 4826 - RNA, 21 nt, Artificial Sequence
  source: /note="Description of Artificial Sequence: Synthetic oligonucleotide"
ugucgaguacacuuuuacuga

SEQ ID NO: 4827 - RNA, 21 nt, Artificial Sequence
  source: /note="Description of Artificial Sequence: Synthetic oligonucleotide"
ugucgaguacacuuuuacuga

SEQ ID NO: 4828 - RNA, 21 nt, Artificial Sequence
  source: /note="Description of Artificial Sequence: Synthetic oligonucleotide"
ugucgaguacacuuuuacuga

SEQ ID NO: 4829 - RNA, 21 nt, Artificial Sequence
  source: /note="Description of Artificial Sequence: Synthetic oligonucleotide"
ugucgaguacacuuuuacuga

SEQ ID NO: 4830 - RNA, 21 nt, Artificial Sequence
  source: /note="Description of Artificial Sequence: Synthetic oligonucleotide"
ugucgaguacacuuuuacuga

SEQ ID NO: 4831 - RNA, 21 nt, Artificial Sequence
  source: /note="Description of Artificial Sequence: Synthetic oligonucleotide"
ugucgaguacacuuuuacuga

SEQ ID NO: 4832 - RNA, 21 nt, Artificial Sequence
  source: /note="Description of Artificial Sequence: Synthetic oligonucleotide"
ugucgaguacacuuuuacuga

SEQ ID NO: 4833 - RNA, 21 nt, Artificial Sequence
  source: /note="Description of Artificial Sequence: Synthetic oligonucleotide"
ugucgaguacacuuuuacuga

SEQ ID NO: 4834 - RNA, 21 nt, Artificial Sequence
  source: /note="Description of Artificial Sequence: Synthetic oligonucleotide"
ugucgaguacacuuuuacuga

SEQ ID NO: 4835 - RNA, 21 nt, Artificial Sequence
  source: /note="Description of Artificial Sequence: Synthetic oligonucleotide"
ugucgaguacacuuuuacuga

SEQ ID NO: 4836 - RNA, 21 nt, Artificial Sequence
  source: /note="Description of Artificial Sequence: Synthetic oligonucleotide"
ugucgaguacacuuuuacuga

SEQ ID NO: 4837 - RNA, 21 nt, Artificial Sequence
  source: /note="Description of Artificial Sequence: Synthetic oligonucleotide"
ugucgaguacacuuuuacuga

SEQ ID NO: 4838 - RNA, 21 nt, Artificial Sequence
  source: /note="Description of Artificial Sequence: Synthetic oligonucleotide"
ugucgaguacacuuuuacuga

SEQ ID NO: 4839 - RNA, 21 nt, Artificial Sequence
  source: /note="Description of Artificial Sequence: Synthetic oligonucleotide"
ugucgaguacacuuuuacuga

SEQ ID NO: 4840 - RNA, 21 nt, Artificial Sequence
  source: /note="Description of Artificial Sequence: Synthetic oligonucleotide"
ugucgaguacacuuuuacuga

SEQ ID NO: 4841 - RNA, 21 nt, Artificial Sequence
  source: /note="Description of Artificial Sequence: Synthetic oligonucleotide"
ugucgaguacacuuuuacuga

SEQ ID NO: 4842 - RNA, 19 nt, Artificial Sequence
  source: /note="Description of Artificial Sequence: Synthetic oligonucleotide"
ucgaguacacuuuuacuga

SEQ ID NO: 4843 - RNA, 19 nt, Artificial Sequence
  source: /note="Description of Artificial Sequence: Synthetic oligonucleotide"
ucgaguacacuuuuacuga

SEQ ID NO: 4844 - RNA, 19 nt, Artificial Sequence
  source: /note="Description of Artificial Sequence: Synthetic oligonucleotide"
ucgaguacacuuuuacuga

SEQ ID NO: 4845 - RNA, 21 nt, Artificial Sequence
  source: /note="Description of Artificial Sequence: Synthetic oligonucleotide"
gaggcuucuguguaggagaaa

SEQ ID NO: 4846 - RNA, 21 nt, Artificial Sequence
  source: /note="Description of Artificial Sequence: Synthetic oligonucleotide"
aggcuucuguguaggagaaua

SEQ ID NO: 4847 - RNA, 21 nt, Artificial Sequence
  source: /note="Description of Artificial Sequence: Synthetic oligonucleotide"
ggcuucuguguaggagaauua

SEQ ID NO: 4848 - RNA, 21 nt, Artificial Sequence
  source: /note="Description of Artificial Sequence: Synthetic oligonucleotide"
gcuucuguguaggagaauuca

SEQ ID NO: 4849 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cuucugugtaggagaauucaa

SEQ ID NO: 4850 - RNA, 21 nt, Artificial Sequence
  source: /note="Description of Artificial Sequence: Synthetic oligonucleotide"
uucuguguaggagaauucaca

SEQ ID NO: 4851 - RNA, 21 nt, Artificial Sequence
  source: /note="Description of Artificial Sequence: Synthetic oligonucleotide"
uucuguguaggagaauucaca

SEQ ID NO: 4852 - RNA, 21 nt, Artificial Sequence
  source: /note="Description of Artificial Sequence: Synthetic oligonucleotide"
uucuguguaggagaauucaca

SEQ ID NO: 4853 - RNA, 21 nt, Artificial Sequence
  source: /note="Description of Artificial Sequence: Synthetic oligonucleotide"
uucuguguaggagaauucaca

SEQ ID NO: 4854 - RNA, 21 nt, Artificial Sequence
  source: /note="Description of Artificial Sequence: Synthetic oligonucleotide"
uucuguguaggagaauucaca

SEQ ID NO: 4855 - RNA, 21 nt, Artificial Sequence
  source: /note="Description of Artificial Sequence: Synthetic oligonucleotide"
uucuguguaggagaauucaca

SEQ ID NO: 4856 - RNA, 21 nt, Artificial Sequence
  source: /note="Description of Artificial Sequence: Synthetic oligonucleotide"
uucuguguaggagaauucaca

SEQ ID NO: 4857 - RNA, 21 nt, Artificial Sequence
  source: /note="Description of Artificial Sequence: Synthetic oligonucleotide"
uucuguguaggagaauucaca

SEQ ID NO: 4858 - RNA, 21 nt, Artificial Sequence
  source: /note="Description of Artificial Sequence: Synthetic oligonucleotide"
ucuguguaggagaauucacua

SEQ ID NO: 4859 - RNA, 21 nt, Artificial Sequence
  source: /note="Description of Artificial Sequence: Synthetic oligonucleotide"
cuguguaggagaauucacuua

SEQ ID NO: 4860 - RNA, 21 nt, Artificial Sequence
  source: /note="Description of Artificial Sequence: Synthetic oligonucleotide"
uguguaggagaauucacuuua

SEQ ID NO: 4861 - RNA, 21 nt, Artificial Sequence
  source: /note="Description of Artificial Sequence: Synthetic oligonucleotide"
guguaggagaauucacuuuua

SEQ ID NO: 4862 - RNA, 21 nt, Artificial Sequence
  source: /note="Description of Artificial Sequence: Synthetic oligonucleotide"
uguaggagaauucacuuuuca

SEQ ID NO: 4863 - RNA, 21 nt, Artificial Sequence
  source: /note="Description of Artificial Sequence: Synthetic oligonucleotide"
uguaggagaauucacuuuuca

SEQ ID NO: 4864 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uguaggagaatucacuuuuca

SEQ ID NO: 4865 - RNA, 21 nt, Artificial Sequence
  source: /note="Description of Artificial Sequence: Synthetic oligonucleotide"
uguaggagaauucacuuuuca

SEQ ID NO: 4866 - RNA, 21 nt, Artificial Sequence
  source: /note="Description of Artificial Sequence: Synthetic oligonucleotide"
uguaggagaauucauuuuuca

SEQ ID NO: 4867 - RNA, 21 nt, Artificial Sequence
  source: /note="Description of Artificial Sequence: Synthetic oligonucleotide"
uguaggagaauucacuuuuca

SEQ ID NO: 4868 - RNA, 21 nt, Artificial Sequence
  source: /note="Description of Artificial Sequence: Synthetic oligonucleotide"
uguaggagaauucacuuuuca

SEQ ID NO: 4869 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uguaggagaatucacuuuuca

SEQ ID NO: 4870 - RNA, 21 nt, Artificial Sequence
  source: /note="Description of Artificial Sequence: Synthetic oligonucleotide"
uguaggagaauucauuuuuca

SEQ ID NO: 4871 - RNA, 21 nt, Artificial Sequence
  source: /note="Description of Artificial Sequence: Synthetic oligonucleotide"
uguaggagaauucacuuuuca

SEQ ID NO: 4872 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uguaggagaatucacuuuuca

SEQ ID NO: 4873 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uguaggagaatucacuuuuca

SEQ ID NO: 4874 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uguaggagaatucauuuuuca

SEQ ID NO: 4875 - RNA, 21 nt, Artificial Sequence
  source: /note="Description of Artificial Sequence: Synthetic oligonucleotide"
uguaggagaauucacuuuuca

SEQ ID NO: 4876 - RNA, 21 nt, Artificial Sequence
  source: /note="Description of Artificial Sequence: Synthetic oligonucleotide"
uguaggagaauucacuuuuca

SEQ ID NO: 4877 - RNA, 21 nt, Artificial Sequence
  source: /note="Description of Artificial Sequence: Synthetic oligonucleotide"
uguaggagaauucacuuuuca

SEQ ID NO: 4878 - RNA, 21 nt, Artificial Sequence
  source: /note="Description of Artificial Sequence: Synthetic oligonucleotide"
uguaggagaauucacuuuuca

SEQ ID NO: 4879 - RNA, 21 nt, Artificial Sequence
  source: /note="Description of Artificial Sequence: Synthetic oligonucleotide"
guaggagaauucacuuuucua

SEQ ID NO: 4880 - RNA, 21 nt, Artificial Sequence
  source: /note="Description of Artificial Sequence: Synthetic oligonucleotide"
guaggagaauucacuuuucua

SEQ ID NO: 4881 - RNA, 21 nt, Artificial Sequence
  source: /note="Description of Artificial Sequence: Synthetic oligonucleotide"
uaggagaauucacuuuucuua

SEQ ID NO: 4882 - RNA, 21 nt, Artificial Sequence
  source: /note="Description of Artificial Sequence: Synthetic oligonucleotide"
uaggagaauucacuuuucuua

SEQ ID NO: 4883 - RNA, 19 nt, Artificial Sequence
  source: /note="Description of Artificial Sequence: Synthetic oligonucleotide"
uaggagaauucacuuuuca

SEQ ID NO: 4884 - RNA, 19 nt, Artificial Sequence
  source: /note="Description of Artificial Sequence: Synthetic oligonucleotide"
uaggagaauucacuuuuca

SEQ ID NO: 4885 - RNA, 21 nt, Artificial Sequence
  source: /note="Description of Artificial Sequence: Synthetic oligonucleotide"
aggagaauucacuuuucuuca

SEQ ID NO: 4886 - RNA, 21 nt, Artificial Sequence
  source: /note="Description of Artificial Sequence: Synthetic oligonucleotide"
ggagaauucacuuuucuucga

SEQ ID NO: 4887 - RNA, 21 nt, Artificial Sequence
  source: /note="Description of Artificial Sequence: Synthetic oligonucleotide"
ggagaauucacuuuucuucga

SEQ ID NO: 4888 - RNA, 21 nt, Artificial Sequence
  source: /note="Description of Artificial Sequence: Synthetic oligonucleotide"
gagaauucacuuuucuucgua

SEQ ID NO: 4889 - RNA, 21 nt, Artificial Sequence
  source: /note="Description of Artificial Sequence: Synthetic oligonucleotide"
ccugaagcauaaauguuuuca

SEQ ID NO: 4890 - RNA, 21 nt, Artificial Sequence
  source: /note="Description of Artificial Sequence: Synthetic oligonucleotide"
cugaagcauaaauguuuucga

SEQ ID NO: 4891 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cugaagcataaauguuuucga

SEQ ID NO: 4892 - RNA, 21 nt, Artificial Sequence
  source: /note="Description of Artificial Sequence: Synthetic oligonucleotide"
ugaagcauaaauguuuucgaa

SEQ ID NO: 4893 - RNA, 21 nt, Artificial Sequence
  source: /note="Description of Artificial Sequence: Synthetic oligonucleotide"
gaagcauaaauguuuucgaaa

SEQ ID NO: 4894 - RNA, 21 nt, Artificial Sequence
  source: /note="Description of Artificial Sequence: Synthetic oligonucleotide"
gaagcauaaauguuuucgaaa

SEQ ID NO: 4895 - RNA, 21 nt, Artificial Sequence
  source: /note="Description of Artificial Sequence: Synthetic oligonucleotide"
aagcauaaauguuuucgaaaa

SEQ ID NO: 4896 - RNA, 21 nt, Artificial Sequence
  source: /note="Description of Artificial Sequence: Synthetic oligonucleotide"
agcauaaauguuuucgaaaua

SEQ ID NO: 4897 - RNA, 21 nt, Artificial Sequence
  source: /note="Description of Artificial Sequence: Synthetic oligonucleotide"
agcauaaauguuuucgaaaua

SEQ ID NO: 4898 - RNA, 21 nt, Artificial Sequence
  source: /note="Description of Artificial Sequence: Synthetic oligonucleotide"
agcauaaauguuuucgaaaua

SEQ ID NO: 4899 - RNA, 21 nt, Artificial Sequence
  source: /note="Description of Artificial Sequence: Synthetic oligonucleotide"
agcauaaauguuuucgaaaua

SEQ ID NO: 4900 - RNA, 21 nt, Artificial Sequence
  source: /note="Description of Artificial Sequence: Synthetic oligonucleotide"
agcauaaauguuuuugaaaua

SEQ ID NO: 4901 - RNA, 21 nt, Artificial Sequence
  source: /note="Description of Artificial Sequence: Synthetic oligonucleotide"
agcauaaauguuuucgaaaua

SEQ ID NO: 4902 - RNA, 21 nt, Artificial Sequence
  source: /note="Description of Artificial Sequence: Synthetic oligonucleotide"
agcauaaauguuuucgaaaua

SEQ ID NO: 4903 - RNA, 21 nt, Artificial Sequence
  source: /note="Description of Artificial Sequence: Synthetic oligonucleotide"
agcauaaauguuuucgaaaua

SEQ ID NO: 4904 - RNA, 21 nt, Artificial Sequence
  source: /note="Description of Artificial Sequence: Synthetic oligonucleotide"
agcauaaauguuuucgaaaua

SEQ ID NO: 4905 - RNA, 21 nt, Artificial Sequence
  source: /note="Description of Artificial Sequence: Synthetic oligonucleotide"
gcauaaauguuuucgaaauua

SEQ ID NO: 4906 - RNA, 21 nt, Artificial Sequence
  source: /note="Description of Artificial Sequence: Synthetic oligonucleotide"
cauaaauguuuucgaaauuca

SEQ ID NO: 4907 - RNA, 19 nt, Artificial Sequence
  source: /note="Description of Artificial Sequence: Synthetic oligonucleotide"
cauaaauguuuucgaaaua

SEQ ID NO: 4908 - RNA, 21 nt, Artificial Sequence
  source: /note="Description of Artificial Sequence: Synthetic oligonucleotide"
auaaauguuuucgaaauucaa

SEQ ID NO: 4909 - RNA, 21 nt, Artificial Sequence
  source: /note="Description of Artificial Sequence: Synthetic oligonucleotide"
auaaauguuuucgaaauucaa

SEQ ID NO: 4910 - RNA, 21 nt, Artificial Sequence
  source: /note="Description of Artificial Sequence: Synthetic oligonucleotide"
uaaauguuuucgaaauucaca

SEQ ID NO: 4911 - RNA, 21 nt, Artificial Sequence
  source: /note="Description of Artificial Sequence: Synthetic oligonucleotide"
aaauguuuucgaaauucacua

SEQ ID NO: 4912 - RNA, 21 nt, Artificial Sequence
  source: /note="Description of Artificial Sequence: Synthetic oligonucleotide"
uacaugaucuucuuugucgua

SEQ ID NO: 4913 - RNA, 21 nt, Artificial Sequence
  source: /note="Description of Artificial Sequence: Synthetic oligonucleotide"
uacaugaucuucuuugucgua

SEQ ID NO: 4914 - RNA, 21 nt, Artificial Sequence
  source: /note="Description of Artificial Sequence: Synthetic oligonucleotide"
acaugaucuucuuugucguaa

SEQ ID NO: 4915 - RNA, 21 nt, Artificial Sequence
  source: /note="Description of Artificial Sequence: Synthetic oligonucleotide"
caugaucuucuuugucguaga

SEQ ID NO: 4916 - RNA, 21 nt, Artificial Sequence
  source: /note="Description of Artificial Sequence: Synthetic oligonucleotide"
caugaucuucuuugucguaga

SEQ ID NO: 4917 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
caugaucutctuugucguaga

SEQ ID NO: 4918 - RNA, 21 nt, Artificial Sequence
  source: /note="Description of Artificial Sequence: Synthetic oligonucleotide"
caugaucuucuuugucguaga

SEQ ID NO: 4919 - RNA, 21 nt, Artificial Sequence
  source: /note="Description of Artificial Sequence: Synthetic oligonucleotide"
caugaucuucuuugucguaga

SEQ ID NO: 4920 - RNA, 21 nt, Artificial Sequence
  source: /note="Description of Artificial Sequence: Synthetic oligonucleotide"
caugaucuucuuugucguaga

SEQ ID NO: 4921 - RNA, 21 nt, Artificial Sequence
  source: /note="Description of Artificial Sequence: Synthetic oligonucleotide"
caugaucuucuuugucguaga

SEQ ID NO: 4922 - RNA, 21 nt, Artificial Sequence
  source: /note="Description of Artificial Sequence: Synthetic oligonucleotide"
caugaucuucuuugucguaga

SEQ ID NO: 4923 - RNA, 21 nt, Artificial Sequence
  source: /note="Description of Artificial Sequence: Synthetic oligonucleotide"
caugaucuucuuugucguaga

SEQ ID NO: 4924 - RNA, 21 nt, Artificial Sequence
  source: /note="Description of Artificial Sequence: Synthetic oligonucleotide"
caugaucuucuuugucguaga

SEQ ID NO: 4925 - RNA, 21 nt, Artificial Sequence
  source: /note="Description of Artificial Sequence: Synthetic oligonucleotide"
caugaucuucuuugucguaga

SEQ ID NO: 4926 - RNA, 21 nt, Artificial Sequence
  source: /note="Description of Artificial Sequence: Synthetic oligonucleotide"
augaucuucuuugucguagua

SEQ ID NO: 4927 - RNA, 19 nt, Artificial Sequence
  source: /note="Description of Artificial Sequence: Synthetic oligonucleotide"
ugaucuucuuugucguaga

SEQ ID NO: 4928 - RNA, 21 nt, Artificial Sequence
  source: /note="Description of Artificial Sequence: Synthetic oligonucleotide"
ugaucuucuuugucguaguga

SEQ ID NO: 4929 - RNA, 19 nt, Artificial Sequence
  source: /note="Description of Artificial Sequence: Synthetic oligonucleotide"
ugaucuucuuugucguaga

SEQ ID NO: 4930 - RNA, 21 nt, Artificial Sequence
  source: /note="Description of Artificial Sequence: Synthetic oligonucleotide"
gaucuucuuugucguagugaa

SEQ ID NO: 4931 - RNA, 21 nt, Artificial Sequence
  source: /note="Description of Artificial Sequence: Synthetic oligonucleotide"
gaucuucuuugucguagugaa

SEQ ID NO: 4932 - RNA, 21 nt, Artificial Sequence
  source: /note="Description of Artificial Sequence: Synthetic oligonucleotide"
gaucuucuuugucguagugaa

SEQ ID NO: 4933 - RNA, 21 nt, Artificial Sequence
  source: /note="Description of Artificial Sequence: Synthetic oligonucleotide"
gaucuucuuugucguagugaa

SEQ ID NO: 4934 - RNA, 21 nt, Artificial Sequence
  source: /note="Description of Artificial Sequence: Synthetic oligonucleotide"
gaucuucuuugucguagugaa

SEQ ID NO: 4935 - RNA, 21 nt, Artificial Sequence
  source: /note="Description of Artificial Sequence: Synthetic oligonucleotide"
gaucuucuuugucguagugaa

SEQ ID NO: 4936 - RNA, 21 nt, Artificial Sequence
  source: /note="Description of Artificial Sequence: Synthetic oligonucleotide"
gaucuucuuugucguagugaa

SEQ ID NO: 4937 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gaucuucutugucguagugaa

SEQ ID NO: 4938 - RNA, 21 nt, Artificial Sequence
  source: /note="Description of Artificial Sequence: Synthetic oligonucleotide"
gaucuucuuugucguagugaa

SEQ ID NO: 4939 - RNA, 21 nt, Artificial Sequence
  source: /note="Description of Artificial Sequence: Synthetic oligonucleotide"
gaucuucuuugucguagugaa

SEQ ID NO: 4940 - RNA, 21 nt, Artificial Sequence
  source: /note="Description of Artificial Sequence: Synthetic oligonucleotide"
gaucuucuuugucguagugaa

SEQ ID NO: 4941 - RNA, 21 nt, Artificial Sequence
  source: /note="Description of Artificial Sequence: Synthetic oligonucleotide"
gaucuucuuugucguagugaa

SEQ ID NO: 4942 - RNA, 21 nt, Artificial Sequence
  source: /note="Description of Artificial Sequence: Synthetic oligonucleotide"
gaucuucuuugucguagugaa

SEQ ID NO: 4943 - RNA, 21 nt, Artificial Sequence
  source: /note="Description of Artificial Sequence: Synthetic oligonucleotide"
aucuucuuugucguagugaua

SEQ ID NO: 4944 - RNA, 19 nt, Artificial Sequence
  source: /note="Description of Artificial Sequence: Synthetic oligonucleotide"
ucuucuuugucguagugaa

SEQ ID NO: 4945 - RNA, 19 nt, Artificial Sequence
  source: /note="Description of Artificial Sequence: Synthetic oligonucleotide"
ucuucuuugucguagugaa

SEQ ID NO: 4946 - RNA, 21 nt, Artificial Sequence
  source: /note="Description of Artificial Sequence: Synthetic oligonucleotide"
ucuucuuugucguagugauua

SEQ ID NO: 4947 - RNA, 21 nt, Artificial Sequence
  source: /note="Description of Artificial Sequence: Synthetic oligonucleotide"
cuucuuugucguagugauuua

SEQ ID NO: 4948 - RNA, 21 nt, Artificial Sequence
  source: /note="Description of Artificial Sequence: Synthetic oligonucleotide"
uucuuugucguagugauuuua

SEQ ID NO: 4949 - RNA, 21 nt, Artificial Sequence
  source: /note="Description of Artificial Sequence: Synthetic oligonucleotide"
ucuuugucguagugauuuuca

SEQ ID NO: 4950 - RNA, 21 nt, Artificial Sequence
  source: /note="Description of Artificial Sequence: Synthetic oligonucleotide"
auccuuuuguagaucuugcaa

SEQ ID NO: 4951 - RNA, 21 nt, Artificial Sequence
  source: /note="Description of Artificial Sequence: Synthetic oligonucleotide"
uccuuuuguagaucuugcaaa

SEQ ID NO: 4952 - RNA, 21 nt, Artificial Sequence
  source: /note="Description of Artificial Sequence: Synthetic oligonucleotide"
ccuuuuguagaucuugcaaua

SEQ ID NO: 4953 - RNA, 21 nt, Artificial Sequence
  source: /note="Description of Artificial Sequence: Synthetic oligonucleotide"
cuuuuguagaucuugcaauua

SEQ ID NO: 4954 - RNA, 21 nt, Artificial Sequence
  source: /note="Description of Artificial Sequence: Synthetic oligonucleotide"
uuuuguagaucuugcaauuaa

SEQ ID NO: 4955 - RNA, 21 nt, Artificial Sequence
  source: /note="Description of Artificial Sequence: Synthetic oligonucleotide"
uuuuguagaucuugcaauuaa

SEQ ID NO: 4956 - RNA, 21 nt, Artificial Sequence
  source: /note="Description of Artificial Sequence: Synthetic oligonucleotide"
uuuguagaucuugcaauuaca

SEQ ID NO: 4957 - RNA, 21 nt, Artificial Sequence
  source: /note="Description of Artificial Sequence: Synthetic oligonucleotide"
uuuguagaucuugcaauuaca

SEQ ID NO: 4958 - RNA, 21 nt, Artificial Sequence
  source: /note="Description of Artificial Sequence: Synthetic oligonucleotide"
uuuguagaucuugcaauuaca

SEQ ID NO: 4959 - RNA, 21 nt, Artificial Sequence
  source: /note="Description of Artificial Sequence: Synthetic oligonucleotide"
uuuguagaucuugcaauuaca

SEQ ID NO: 4960 - RNA, 21 nt, Artificial Sequence
  source: /note="Description of Artificial Sequence: Synthetic oligonucleotide"
uuuguagaucuugcaauuaca

SEQ ID NO: 4961 - RNA, 21 nt, Artificial Sequence
  source: /note="Description of Artificial Sequence: Synthetic oligonucleotide"
uuuguagaucuugcaauuaca

SEQ ID NO: 4962 - RNA, 21 nt, Artificial Sequence
  source: /note="Description of Artificial Sequence: Synthetic oligonucleotide"
uuguagaucuugcaauuacca

SEQ ID NO: 4963 - RNA, 21 nt, Artificial Sequence
  source: /note="Description of Artificial Sequence: Synthetic oligonucleotide"
uguagaucuugcaauuaccaa

SEQ ID NO: 4964 - RNA, 21 nt, Artificial Sequence
  source: /note="Description of Artificial Sequence: Synthetic oligonucleotide"
guagaucuugcaauuaccaua

SEQ ID NO: 4965 - RNA, 21 nt, Artificial Sequence
  source: /note="Description of Artificial Sequence: Synthetic oligonucleotide"
uagaucuugcaauuaccauua

SEQ ID NO: 4966 - RNA, 21 nt, Artificial Sequence
  source: /note="Description of Artificial Sequence: Synthetic oligonucleotide"
agaucuugcaauuaccauuua

SEQ ID NO: 4967 - RNA, 21 nt, Artificial Sequence
  source: /note="Description of Artificial Sequence: Synthetic oligonucleotide"
agaucuugcaauuaccauuua

SEQ ID NO: 4968 - RNA, 21 nt, Artificial Sequence
  source: /note="Description of Artificial Sequence: Synthetic oligonucleotide"
uaaauuaugugaaacaaacca

SEQ ID NO: 4969 - RNA, 21 nt, Artificial Sequence
  source: /note="Description of Artificial Sequence: Synthetic oligonucleotide"
aauuaugugaaacaaaccuua

SEQ ID NO: 4970 - RNA, 21 nt, Artificial Sequence
  source: /note="Description of Artificial Sequence: Synthetic oligonucleotide"
auuaugugaaacaaaccuuaa

SEQ ID NO: 4971 - RNA, 21 nt, Artificial Sequence
  source: /note="Description of Artificial Sequence: Synthetic oligonucleotide"
auuaugugaaacaaaccuuaa

SEQ ID NO: 4972 - RNA, 21 nt, Artificial Sequence
  source: /note="Description of Artificial Sequence: Synthetic oligonucleotide"
uuaugugaaacaaaccuuaca

SEQ ID NO: 4973 - RNA, 21 nt, Artificial Sequence
  source: /note="Description of Artificial Sequence: Synthetic oligonucleotide"
uaugugaaacaaaccuuacga

SEQ ID NO: 4974 - RNA, 21 nt, Artificial Sequence
  source: /note="Description of Artificial Sequence: Synthetic oligonucleotide"
uaugugaaacaaaccuuacga

SEQ ID NO: 4975 - RNA, 21 nt, Artificial Sequence
  source: /note="Description of Artificial Sequence: Synthetic oligonucleotide"
uaugugaaacaaacuuuacga

SEQ ID NO: 4976 - RNA, 21 nt, Artificial Sequence
  source: /note="Description of Artificial Sequence: Synthetic oligonucleotide"
uaugugaaacaaaccuuacga

SEQ ID NO: 4977 - RNA, 21 nt, Artificial Sequence
  source: /note="Description of Artificial Sequence: Synthetic oligonucleotide"
uaugugaaacaaaccuuacga

SEQ ID NO: 4978 - RNA, 21 nt, Artificial Sequence
  source: /note="Description of Artificial Sequence: Synthetic oligonucleotide"
uaugugaaacaaaccuuacga

SEQ ID NO: 4979 - RNA, 21 nt, Artificial Sequence
  source: /note="Description of Artificial Sequence: Synthetic oligonucleotide"
uaugugaaacaaaccuuacga

SEQ ID NO: 4980 - RNA, 21 nt, Artificial Sequence
  source: /note="Description of Artificial Sequence: Synthetic oligonucleotide"
augugaaacaaaccuuacgua

SEQ ID NO: 4981 - RNA, 21 nt, Artificial Sequence
  source: /note="Description of Artificial Sequence: Synthetic oligonucleotide"
augugaaacaaaccuuacgua

SEQ ID NO: 4982 - RNA, 21 nt, Artificial Sequence
  source: /note="Description of Artificial Sequence: Synthetic oligonucleotide"
augugaaacaaaccuuacgua

SEQ ID NO: 4983 - RNA, 21 nt, Artificial Sequence
  source: /note="Description of Artificial Sequence: Synthetic oligonucleotide"
augugaaacaaaccuuacgua

SEQ ID NO: 4984 - RNA, 21 nt, Artificial Sequence
  source: /note="Description of Artificial Sequence: Synthetic oligonucleotide"
augugaaacaaaccuuacgua

SEQ ID NO: 4985 - RNA, 21 nt, Artificial Sequence
  source: /note="Description of Artificial Sequence: Synthetic oligonucleotide"
augugaaacaaaccuuacgua

SEQ ID NO: 4986 - RNA, 21 nt, Artificial Sequence
  source: /note="Description of Artificial Sequence: Synthetic oligonucleotide"
augugaaacaaaccuuacgua

SEQ ID NO: 4987 - RNA, 21 nt, Artificial Sequence
  source: /note="Description of Artificial Sequence: Synthetic oligonucleotide"
augugaaacaaaccuuacgua

SEQ ID NO: 4988 - RNA, 21 nt, Artificial Sequence
  source: /note="Description of Artificial Sequence: Synthetic oligonucleotide"
ugugaaacaaaccuuacguga

SEQ ID NO: 4989 - RNA, 19 nt, Artificial Sequence
  source: /note="Description of Artificial Sequence: Synthetic oligonucleotide"
gugaaacaaaccuuacgua

SEQ ID NO: 4990 - RNA, 21 nt, Artificial Sequence
  source: /note="Description of Artificial Sequence: Synthetic oligonucleotide"
gugaaacaaaccuuacgugaa

SEQ ID NO: 4991 - RNA, 21 nt, Artificial Sequence
  source: /note="Description of Artificial Sequence: Synthetic oligonucleotide"
gugaaacaaaccuuacgugaa

SEQ ID NO: 4992 - RNA, 21 nt, Artificial Sequence
  source: /note="Description of Artificial Sequence: Synthetic oligonucleotide"
ugaaacaaaccuuacgugaaa

SEQ ID NO: 4993 - RNA, 21 nt, Artificial Sequence
  source: /note="Description of Artificial Sequence: Synthetic oligonucleotide"
gaaacaaaccuuacgugaaua

SEQ ID NO: 4994 - RNA, 21 nt, Artificial Sequence
  source: /note="Description of Artificial Sequence: Synthetic oligonucleotide"
gaaacaaaccuuacgugaaua

SEQ ID NO: 4995 - RNA, 21 nt, Artificial Sequence
  source: /note="Description of Artificial Sequence: Synthetic oligonucleotide"
aaacaaaccuuacgugaauua

SEQ ID NO: 4996 - RNA, 21 nt, Artificial Sequence
  source: /note="Description of Artificial Sequence: Synthetic oligonucleotide"
ugugauauauuuuacaacaua

SEQ ID NO: 4997 - RNA, 21 nt, Artificial Sequence
  source: /note="Description of Artificial Sequence: Synthetic oligonucleotide"
ugugauauauuuuacaacaua

SEQ ID NO: 4998 - RNA, 21 nt, Artificial Sequence
  source: /note="Description of Artificial Sequence: Synthetic oligonucleotide"
gugauauauuuuacaacauca

SEQ ID NO: 4999 - RNA, 21 nt, Artificial Sequence
  source: /note="Description of Artificial Sequence: Synthetic oligonucleotide"
ugauauauuuuacaacaucca

SEQ ID NO: 5000 - RNA, 21 nt, Artificial Sequence
  source: /note="Description of Artificial Sequence: Synthetic oligonucleotide"
gauauauuuuacaacauccga

SEQ ID NO: 5001 - RNA, 21 nt, Artificial Sequence
  source: /note="Description of Artificial Sequence: Synthetic oligonucleotide"
gauauauuuuacaacauccga

SEQ ID NO: 5002 - RNA, 21 nt, Artificial Sequence
  source: /note="Description of Artificial Sequence: Synthetic oligonucleotide"
auauauuuuacaacauccgua

SEQ ID NO: 5003 - RNA, 21 nt, Artificial Sequence
  source: /note="Description of Artificial Sequence: Synthetic oligonucleotide"
auauauuuuacaacauccgua

SEQ ID NO: 5004 - RNA, 21 nt, Artificial Sequence
  source: /note="Description of Artificial Sequence: Synthetic oligonucleotide"
uauauuuuacaacauccguua

SEQ ID NO: 5005 - RNA, 21 nt, Artificial Sequence
  source: /note="Description of Artificial Sequence: Synthetic oligonucleotide"
uauauuuuacaacauccguua

SEQ ID NO: 5006 - RNA, 21 nt, Artificial Sequence
  source: /note="Description of Artificial Sequence: Synthetic oligonucleotide"
uauauuuuacaacauccguua

SEQ ID NO: 5007 - RNA, 21 nt, Artificial Sequence
  source: /note="Description of Artificial Sequence: Synthetic oligonucleotide"
uauauuuuacaacauccguua

SEQ ID NO: 5008 - RNA, 21 nt, Artificial Sequence
  source: /note="Description of Artificial Sequence: Synthetic oligonucleotide"
uauauuuuacaacauccguua

SEQ ID NO: 5009 - RNA, 21 nt, Artificial Sequence
  source: /note="Description of Artificial Sequence: Synthetic oligonucleotide"
uauauuuuacaacauccguua

SEQ ID NO: 5010 - RNA, 21 nt, Artificial Sequence
  source: /note="Description of Artificial Sequence: Synthetic oligonucleotide"
uauauuuuacaacauccguua

SEQ ID NO: 5011 - RNA, 21 nt, Artificial Sequence
  source: /note="Description of Artificial Sequence: Synthetic oligonucleotide"
uauauuuuacaacauccguua

SEQ ID NO: 5012 - RNA, 21 nt, Artificial Sequence
  source: /note="Description of Artificial Sequence: Synthetic oligonucleotide"
uauauuuuacaacauccguua

SEQ ID NO: 5013 - RNA, 21 nt, Artificial Sequence
  source: /note="Description of Artificial Sequence: Synthetic oligonucleotide"
auauuuuacaacauccguuaa

SEQ ID NO: 5014 - RNA, 21 nt, Artificial Sequence
  source: /note="Description of Artificial Sequence: Synthetic oligonucleotide"
auauuuuacaacauccguuaa

SEQ ID NO: 5015 - RNA, 19 nt, Artificial Sequence
  source: /note="Description of Artificial Sequence: Synthetic oligonucleotide"
uauuuuacaacauccguua

SEQ ID NO: 5016 - RNA, 21 nt, Artificial Sequence
  source: /note="Description of Artificial Sequence: Synthetic oligonucleotide"
uauuuuacaacauccguuaua

SEQ ID NO: 5017 - RNA, 19 nt, Artificial Sequence
  source: /note="Description of Artificial Sequence: Synthetic oligonucleotide"
uauuuuacaacauccguua

SEQ ID NO: 5018 - RNA, 21 nt, Artificial Sequence
  source: /note="Description of Artificial Sequence: Synthetic oligonucleotide"
auuuuacaacauccguuauua

SEQ ID NO: 5019 - RNA, 21 nt, Artificial Sequence
  source: /note="Description of Artificial Sequence: Synthetic oligonucleotide"
auuuuacaacauccguuauua

SEQ ID NO: 5020 - RNA, 21 nt, Artificial Sequence
  source: /note="Description of Artificial Sequence: Synthetic oligonucleotide"
uuuuacaacauccguuauuaa

SEQ ID NO: 5021 - RNA, 21 nt, Artificial Sequence
  source: /note="Description of Artificial Sequence: Synthetic oligonucleotide"
uuuacaacauccguuauuaca

SEQ ID NO: 5022 - RNA, 21 nt, Artificial Sequence
  source: /note="Description of Artificial Sequence: Synthetic oligonucleotide"
caacacaauuucuucuuagca

SEQ ID NO: 5023 - RNA, 21 nt, Artificial Sequence
  source: /note="Description of Artificial Sequence: Synthetic oligonucleotide"
caacacaauuucuucuuagca

SEQ ID NO: 5024 - RNA, 21 nt, Artificial Sequence
  source: /note="Description of Artificial Sequence: Synthetic oligonucleotide"
caacacaauuucuucuuagca

SEQ ID NO: 5025 - RNA, 21 nt, Artificial Sequence
  source: /note="Description of Artificial Sequence: Synthetic oligonucleotide"
caacacaauuucuucuuagca

SEQ ID NO: 5026 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
caacacaatutcuucuuagca

SEQ ID NO: 5027 - RNA, 19 nt, Artificial Sequence
  source: /note="Description of Artificial Sequence: Synthetic oligonucleotide"
acacaauuucuucuuagca

SEQ ID NO: 5028 - RNA, 21 nt, Artificial Sequence
  source: /note="Description of Artificial Sequence: Synthetic oligonucleotide"
ggcuucaaguguuccuacuga

SEQ ID NO: 5029 - RNA, 21 nt, Artificial Sequence
  source: /note="Description of Artificial Sequence: Synthetic oligonucleotide"
gcuucaaguguuccuacugua

SEQ ID NO: 5030 - RNA, 21 nt, Artificial Sequence
  source: /note="Description of Artificial Sequence: Synthetic oligonucleotide"
cuucaaguguuccuacuguca

SEQ ID NO: 5031 - RNA, 21 nt, Artificial Sequence
  source: /note="Description of Artificial Sequence: Synthetic oligonucleotide"
uucaaguguuccuacugucaa

SEQ ID NO: 5032 - RNA, 21 nt, Artificial Sequence
  source: /note="Description of Artificial Sequence: Synthetic oligonucleotide"
uucaaguguuccuacugucaa

SEQ ID NO: 5033 - RNA, 21 nt, Artificial Sequence
  source: /note="Description of Artificial Sequence: Synthetic oligonucleotide"
ucaaguguuccuacugucaua

SEQ ID NO: 5034 - RNA, 21 nt, Artificial Sequence
  source: /note="Description of Artificial Sequence: Synthetic oligonucleotide"
ucaaguguuccuacugucaua

SEQ ID NO: 5035 - RNA, 21 nt, Artificial Sequence
  source: /note="Description of Artificial Sequence: Synthetic oligonucleotide"
caaguguuccuacugucauga

SEQ ID NO: 5036 - RNA, 21 nt, Artificial Sequence
  source: /note="Description of Artificial Sequence: Synthetic oligonucleotide"
caaguguuccuacugucauga

SEQ ID NO: 5037 - RNA, 21 nt, Artificial Sequence
  source: /note="Description of Artificial Sequence: Synthetic oligonucleotide"
caaguguuccuacugucauga

SEQ ID NO: 5038 - RNA, 21 nt, Artificial Sequence
  source: /note="Description of Artificial Sequence: Synthetic oligonucleotide"
caaguguuccuacugucauga

SEQ ID NO: 5039 - RNA, 21 nt, Artificial Sequence
  source: /note="Description of Artificial Sequence: Synthetic oligonucleotide"
caaguguuccuacugucauga

SEQ ID NO: 5040 - RNA, 21 nt, Artificial Sequence
  source: /note="Description of Artificial Sequence: Synthetic oligonucleotide"
caaguguuccuacugucauga

SEQ ID NO: 5041 - RNA, 21 nt, Artificial Sequence
  source: /note="Description of Artificial Sequence: Synthetic oligonucleotide"
caaguguuccuacugucauga

SEQ ID NO: 5042 - RNA, 21 nt, Artificial Sequence
  source: /note="Description of Artificial Sequence: Synthetic oligonucleotide"
caaguguuccuacugucauga

SEQ ID NO: 5043 - RNA, 21 nt, Artificial Sequence
  source: /note="Description of Artificial Sequence: Synthetic oligonucleotide"
caaguguuccuacugucauga

SEQ ID NO: 5044 - RNA, 21 nt, Artificial Sequence
  source: /note="Description of Artificial Sequence: Synthetic oligonucleotide"
aaguguuccuacugucaugaa

SEQ ID NO: 5045 - RNA, 19 nt, Artificial Sequence
  source: /note="Description of Artificial Sequence: Synthetic oligonucleotide"
aguguuccuacugucauga

SEQ ID NO: 5046 - RNA, 19 nt, Artificial Sequence
  source: /note="Description of Artificial Sequence: Synthetic oligonucleotide"
aguguuccuacugucauga

SEQ ID NO: 5047 - RNA, 21 nt, Artificial Sequence
  source: /note="Description of Artificial Sequence: Synthetic oligonucleotide"
aguguuccuacugucaugaca

SEQ ID NO: 5048 - RNA, 21 nt, Artificial Sequence
  source: /note="Description of Artificial Sequence: Synthetic oligonucleotide"
guguuccuacugucaugacca

SEQ ID NO: 5049 - RNA, 21 nt, Artificial Sequence
  source: /note="Description of Artificial Sequence: Synthetic oligonucleotide"
uguuccuacugucaugaccua

SEQ ID NO: 5050 - RNA, 21 nt, Artificial Sequence
  source: /note="Description of Artificial Sequence: Synthetic oligonucleotide"
guuccuacugucaugaccuga

SEQ ID NO: 5051 - RNA, 21 nt, Artificial Sequence
  source: /note="Description of Artificial Sequence: Synthetic oligonucleotide"
uugauaguuaccuaguuugca

SEQ ID NO: 5052 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uugauagutaccuaguuugca

SEQ ID NO: 5053 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uugauagutaccuaguuugca

SEQ ID NO: 5054 - RNA, 21 nt, Artificial Sequence
  source: /note="Description of Artificial Sequence: Synthetic oligonucleotide"
uugauaguuaccuaguuugca

SEQ ID NO: 5055 - RNA, 21 nt, Artificial Sequence
  source: /note="Description of Artificial Sequence: Synthetic oligonucleotide"
uugauaguuaccuaguuugca

SEQ ID NO: 5056 - RNA, 21 nt, Artificial Sequence
  source: /note="Description of Artificial Sequence: Synthetic oligonucleotide"
uugauaguuaccuaguuugca

SEQ ID NO: 5057 - RNA, 21 nt, Artificial Sequence
  source: /note="Description of Artificial Sequence: Synthetic oligonucleotide"
uugauaguuaccuaguuugca

SEQ ID NO: 5058 - RNA, 21 nt, Artificial Sequence
  source: /note="Description of Artificial Sequence: Synthetic oligonucleotide"
uugauaguuaccuaauuugca

SEQ ID NO: 5059 - RNA, 21 nt, Artificial Sequence
  source: /note="Description of Artificial Sequence: Synthetic oligonucleotide"
uugauaguuaccuaguuugca

SEQ ID NO: 5060 - RNA, 21 nt, Artificial Sequence
  source: /note="Description of Artificial Sequence: Synthetic oligonucleotide"
uugauaguuaccuaguuugca

SEQ ID NO: 5061 - DNA, 19 bp, Artificial Sequence
  source: /note="Description of Artificial Sequence: Synthetic oligonucleotide"
  source: /note="Description of Combined DNA/RNA Molecule: Synthetic oligonucleotide"
gauagutaccuaguuugca

SEQ ID NO: 5062 - RNA, 19 nt, Artificial Sequence
  source: /note="Description of Artificial Sequence: Synthetic oligonucleotide"
gauaguuaccuaguuugca

SEQ ID NO: 5063 - RNA, 19 nt, Artificial Sequence
  source: /note="Description of Artificial Sequence: Synthetic oligonucleotide"
gauaguuaccuaguuugca

SEQ ID NO: 5064 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uagatuguuuucccuuuguguuc

SEQ ID NO: 5065 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uaagautguuuucccuuuguguu

SEQ ID NO: 5066 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugaagatuguuuucccuuugugu

SEQ ID NO: 5067 - RNA, 23 nt, Artificial Sequence
  source: /note="Description of Artificial Sequence: Synthetic oligonucleotide"
uggaagauuguuuucccuuugug

SEQ ID NO: 5068 - RNA, 23 nt, Artificial Sequence
  source: /note="Description of Artificial Sequence: Synthetic oligonucleotide"
ucggaagauuguuuucccuuugu

SEQ ID NO: 5069 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucggaagauugtuuucccuuugu

SEQ ID NO: 5070 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uacggaagauuguuutcccuuug

SEQ ID NO: 5071 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uacggaagauuguuutcccuuug

SEQ ID NO: 5072 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uacggaagauugututcccuuug

SEQ ID NO: 5073 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uacggaagauugututcccuuug

SEQ ID NO: 5074 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uacggaagauuguuutcccuuug

SEQ ID NO: 5075 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uacggaagauuguuutcccuuug

SEQ ID NO: 5076 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uacggaagauuguuutcccuuug

SEQ ID NO: 5077 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uacggaagauuguuutcccuuug

SEQ ID NO: 5078 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uacggaagauuguuutcccuucc

SEQ ID NO: 5079 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uacggaagauuguuutcccuuug

SEQ ID NO: 5080 - RNA, 23 nt, Artificial Sequence
  source: /note="Description of Artificial Sequence: Synthetic oligonucleotide"
uaacggaagauuguuuucccuuu

SEQ ID NO: 5081 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uaacggaagautguuuucccuuu

SEQ ID NO: 5082 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uacggaagauuguuutcccuu

SEQ ID NO: 5083 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uacggaagauuguuutcccuu

SEQ ID NO: 5084 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uaaacggaagatuguuuucccuu

SEQ ID NO: 5085 - RNA, 23 nt, Artificial Sequence
  source: /note="Description of Artificial Sequence: Synthetic oligonucleotide"
ugaaacggaagauuguuuucccu

SEQ ID NO: 5086 - RNA, 23 nt, Artificial Sequence
  source: /note="Description of Artificial Sequence: Synthetic oligonucleotide"
uugaaacggaagauuguuuuccc

SEQ ID NO: 5087 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uugaaatggaagauuguuuuccc

SEQ ID NO: 5088 - RNA, 23 nt, Artificial Sequence
  source: /note="Description of Artificial Sequence: Synthetic oligonucleotide"
uuugaaacggaagauuguuuucc

SEQ ID NO: 5089 - RNA, 23 nt, Artificial Sequence
  source: /note="Description of Artificial Sequence: Synthetic oligonucleotide"
uuugaaacggaagauuguuuucc

SEQ ID NO: 5090 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucagtaaaaguguacucgacauu

SEQ ID NO: 5091 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucagtaaaaguguacucgacacc

SEQ ID NO: 5092 - RNA, 23 nt, Artificial Sequence
  source: /note="Description of Artificial Sequence: Synthetic oligonucleotide"
ucaguaaaaguguacucgacauu

SEQ ID NO: 5093 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucagtaaaaguguactcgacauu

SEQ ID NO: 5094 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucagtaaaaguguacucgacacc

SEQ ID NO: 5095 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucagtaaaaguguactcgacacc

SEQ ID NO: 5096 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucagtaaaaguguactcgacauu

SEQ ID NO: 5097 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucagtaaaaguguactcgacauu

SEQ ID NO: 5098 - RNA, 23 nt, Artificial Sequence
  source: /note="Description of Artificial Sequence: Synthetic oligonucleotide"
ucaguaaaaguguacucgacauu

SEQ ID NO: 5099 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucagtaaaaguguacucgacacc

SEQ ID NO: 5100 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucagtaaaaguguactcgacauu

SEQ ID NO: 5101 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucagtaaaaguguactcgacauu

SEQ ID NO: 5102 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucagtaaaaguguacucgacacc

SEQ ID NO: 5103 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucagtaaaaguguactcgacauu

SEQ ID NO: 5104 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucagtaaaaguguacucgacauu

SEQ ID NO: 5105 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucagtaaaaguguactcgacacc

SEQ ID NO: 5106 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucagtaaaaguguactcgacacc

SEQ ID NO: 5107 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucagtaaaaguguactcgacauu

SEQ ID NO: 5108 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucagtaaaaguguacucgacg

SEQ ID NO: 5109 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucagtaaaaguguactcgacg

SEQ ID NO: 5110 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucagtaaaaguguactcgacg

SEQ ID NO: 5111 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uuuctccuacacagaagccucuu

SEQ ID NO: 5112 - RNA, 23 nt, Artificial Sequence
  source: /note="Description of Artificial Sequence: Synthetic oligonucleotide"
uauucuccuacacagaagccucu

SEQ ID NO: 5113 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uaautctccuacacagaagccuc

SEQ ID NO: 5114 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugaatucuccuacacagaagccu

SEQ ID NO: 5115 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uugaautcucctacacagaagcc

SEQ ID NO: 5116 - RNA, 23 nt, Artificial Sequence
  source: /note="Description of Artificial Sequence: Synthetic oligonucleotide"
ugugaauucuccuacacagaagc

SEQ ID NO: 5117 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugugaatucuccuacacagaagc

SEQ ID NO: 5118 - RNA, 23 nt, Artificial Sequence
  source: /note="Description of Artificial Sequence: Synthetic oligonucleotide"
ugugaauucuccuacacagaagc

SEQ ID NO: 5119 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugugaatucuccuacacagaagc

SEQ ID NO: 5120 - RNA, 23 nt, Artificial Sequence
  source: /note="Description of Artificial Sequence: Synthetic oligonucleotide"
ugugaauucuccuacacagaagc

SEQ ID NO: 5121 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugugaatucuccuacacagaagc

SEQ ID NO: 5122 - RNA, 23 nt, Artificial Sequence
  source: /note="Description of Artificial Sequence: Synthetic oligonucleotide"
ugugaauucuccuacacagaauc

SEQ ID NO: 5123 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugugaatucuccuacacagaauc

SEQ ID NO: 5124 - RNA, 23 nt, Artificial Sequence
  source: /note="Description of Artificial Sequence: Synthetic oligonucleotide"
uagugaauucuccuacacagagg

SEQ ID NO: 5125 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uaagtgaauuctccuacacaggg

SEQ ID NO: 5126 - RNA, 23 nt, Artificial Sequence
  source: /note="Description of Artificial Sequence: Synthetic oligonucleotide"
uaaagugaauucuccuacacagg

SEQ ID NO: 5127 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uaaaagtgaautcuccuacacgg

SEQ ID NO: 5128 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugaaaagugaatucuccuacacg

SEQ ID NO: 5129 - RNA, 23 nt, Artificial Sequence
  source: /note="Description of Artificial Sequence: Synthetic oligonucleotide"
ugaaaagugaauucuccuacaca

SEQ ID NO: 5130 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugaaaagugaatucuccuacaca

SEQ ID NO: 5131 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugaaaagugaatucuccuacacg

SEQ ID NO: 5132 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugaaaaaugaatucuccuacacg

SEQ ID NO: 5133 - RNA, 23 nt, Artificial Sequence
  source: /note="Description of Artificial Sequence: Synthetic oligonucleotide"
ugaaaagugaauucuccuacaca

SEQ ID NO: 5134 - RNA, 21 nt, Artificial Sequence
  source: /note="Description of Artificial Sequence: Synthetic oligonucleotide"
ugaaaagugaauucuccuacg

SEQ ID NO: 5135 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugaaaagugaatucuccuacacg

SEQ ID NO: 5136 - RNA, 23 nt, Artificial Sequence
  source: /note="Description of Artificial Sequence: Synthetic oligonucleotide"
ugaaaaaugaauucuccuacacg

SEQ ID NO: 5137 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugaaaagugaatucuccuacacg

SEQ ID NO: 5138 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugaaaagugaatucuccuacacg

SEQ ID NO: 5139 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugaaaagugaatucuccuacacg

SEQ ID NO: 5140 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugaaaaaugaatucuccuacacg

SEQ ID NO: 5141 - RNA, 23 nt, Artificial Sequence
  source: /note="Description of Artificial Sequence: Synthetic oligonucleotide"
ugaaaagugaauucuccuacacg

SEQ ID NO: 5142 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugaaaagugaatucuccuacacg

SEQ ID NO: 5143 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugaaaagugaatucuccuacacg

SEQ ID NO: 5144 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugaaaagugaatucuccuacacg

SEQ ID NO: 5145 - RNA, 23 nt, Artificial Sequence
  source: /note="Description of Artificial Sequence: Synthetic oligonucleotide"
uagaaaagugaauucuccuacgc

SEQ ID NO: 5146 - RNA, 23 nt, Artificial Sequence
  source: /note="Description of Artificial Sequence: Synthetic oligonucleotide"
uagaaaagugaauucuccuacgc

SEQ ID NO: 5147 - RNA, 23 nt, Artificial Sequence
  source: /note="Description of Artificial Sequence: Synthetic oligonucleotide"
uaagaaaagugaauucuccuacg

SEQ ID NO: 5148 - RNA, 23 nt, Artificial Sequence
  source: /note="Description of Artificial Sequence: Synthetic oligonucleotide"
uaagaaaagugaauucuccuacg

SEQ ID NO: 5149 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugaaaagugaatucuccuacg

SEQ ID NO: 5150 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugaaaagugaatucuccuacg

SEQ ID NO: 5151 - RNA, 23 nt, Artificial Sequence
  source: /note="Description of Artificial Sequence: Synthetic oligonucleotide"
ugaagaaaagugaauucuccugc

SEQ ID NO: 5152 - RNA, 23 nt, Artificial Sequence
  source: /note="Description of Artificial Sequence: Synthetic oligonucleotide"
ucgaagaaaagugaauucuccug

SEQ ID NO: 5153 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucgaagaaaagtgaauucuccug

SEQ ID NO: 5154 - RNA, 23 nt, Artificial Sequence
  source: /note="Description of Artificial Sequence: Synthetic oligonucleotide"
uacgaagaaaagugaauucuccu

SEQ ID NO: 5155 - RNA, 23 nt, Artificial Sequence
  source: /note="Description of Artificial Sequence: Synthetic oligonucleotide"
ugaaaacauuuaugcuucagguu

SEQ ID NO: 5156 - RNA, 23 nt, Artificial Sequence
  source: /note="Description of Artificial Sequence: Synthetic oligonucleotide"
ucgaaaacauuuaugcuucaggu

SEQ ID NO: 5157 - RNA, 23 nt, Artificial Sequence
  source: /note="Description of Artificial Sequence: Synthetic oligonucleotide"
ucgaaaacauuuaugcuucaggu

SEQ ID NO: 5158 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uucgaaaacautuaugcuucagg

SEQ ID NO: 5159 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uuucgaaaacatuuaugcuucag

SEQ ID NO: 5160 - RNA, 23 nt, Artificial Sequence
  source: /note="Description of Artificial Sequence: Synthetic oligonucleotide"
uuucgaaaacauuuaugcuucag

SEQ ID NO: 5161 - RNA, 23 nt, Artificial Sequence
  source: /note="Description of Artificial Sequence: Synthetic oligonucleotide"
uuuucgaaaacauuuaugcuucg

SEQ ID NO: 5162 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uauutcgaaaacauuuaugcuuc

SEQ ID NO: 5163 - RNA, 23 nt, Artificial Sequence
  source: /note="Description of Artificial Sequence: Synthetic oligonucleotide"
uauuucgaaaacauuuaugcuuc

SEQ ID NO: 5164 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uauutcgaaaacauuuaugcuuc

SEQ ID NO: 5165 - RNA, 23 nt, Artificial Sequence
  source: /note="Description of Artificial Sequence: Synthetic oligonucleotide"
uauuucgaaaacauuuaugcuuc

SEQ ID NO: 5166 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uauutcaaaaacauuuaugcuuc

SEQ ID NO: 5167 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uauutcgaaaacauuuaugcuuc

SEQ ID NO: 5168 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uauutcgaaaacauuuaugcucc

SEQ ID NO: 5169 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uauutcgaaaacauuuaugcuuc

SEQ ID NO: 5170 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uauutcgaaaacauuuaugcucc

SEQ ID NO: 5171 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uaautucgaaaacauuuaugcuu

SEQ ID NO: 5172 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugaatutcgaaaacauuuaugcu

SEQ ID NO: 5173 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uauutcgaaaacauuuaugcu

SEQ ID NO: 5174 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uugaautucgaaaacauuuaugc

SEQ ID NO: 5175 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uugaautucgaaaacauuuaugu

SEQ ID NO: 5176 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugugaatuucgaaaacauuuaug

SEQ ID NO: 5177 - RNA, 23 nt, Artificial Sequence
  source: /note="Description of Artificial Sequence: Synthetic oligonucleotide"
uagugaauuucgaaaacauuugu

SEQ ID NO: 5178 - RNA, 23 nt, Artificial Sequence
  source: /note="Description of Artificial Sequence: Synthetic oligonucleotide"
uacgacaaagaagaucauguagg

SEQ ID NO: 5179 - RNA, 23 nt, Artificial Sequence
  source: /note="Description of Artificial Sequence: Synthetic oligonucleotide"
uacgacaaagaagaucauguacc

SEQ ID NO: 5180 - RNA, 23 nt, Artificial Sequence
  source: /note="Description of Artificial Sequence: Synthetic oligonucleotide"
uuacgacaaagaagaucaugugg

SEQ ID NO: 5181 - RNA, 23 nt, Artificial Sequence
  source: /note="Description of Artificial Sequence: Synthetic oligonucleotide"
ucuacgacaaagaagaucaugug

SEQ ID NO: 5182 - RNA, 23 nt, Artificial Sequence
  source: /note="Description of Artificial Sequence: Synthetic oligonucleotide"
ucuacgacaaagaagaucaugug

SEQ ID NO: 5183 - RNA, 23 nt, Artificial Sequence
  source: /note="Description of Artificial Sequence: Synthetic oligonucleotide"
ucuacgacaaagaagaucaugua

SEQ ID NO: 5184 - RNA, 23 nt, Artificial Sequence
  source: /note="Description of Artificial Sequence: Synthetic oligonucleotide"
ucuacgacaaagaagaucaugug

SEQ ID NO: 5185 - RNA, 23 nt, Artificial Sequence
  source: /note="Description of Artificial Sequence: Synthetic oligonucleotide"
ucuacgacaaagaagaucaugug

SEQ ID NO: 5186 - RNA, 23 nt, Artificial Sequence
  source: /note="Description of Artificial Sequence: Synthetic oligonucleotide"
ucuacgacaaagaagaucaugcc

SEQ ID NO: 5187 - RNA, 23 nt, Artificial Sequence
  source: /note="Description of Artificial Sequence: Synthetic oligonucleotide"
ucuacgacaaagaagaucaugug

SEQ ID NO: 5188 - RNA, 23 nt, Artificial Sequence
  source: /note="Description of Artificial Sequence: Synthetic oligonucleotide"
ucuacgacaaagaagaucaugug

SEQ ID NO: 5189 - RNA, 23 nt, Artificial Sequence
  source: /note="Description of Artificial Sequence: Synthetic oligonucleotide"
ucuacgacaaagaagaucaugcc

SEQ ID NO: 5190 - RNA, 23 nt, Artificial Sequence
  source: /note="Description of Artificial Sequence: Synthetic oligonucleotide"
ucuacgacaaagaagaucaugug

SEQ ID NO: 5191 - RNA, 23 nt, Artificial Sequence
  source: /note="Description of Artificial Sequence: Synthetic oligonucleotide"
ucuacgacaaagaagaucaugug

SEQ ID NO: 5192 - RNA, 23 nt, Artificial Sequence
  source: /note="Description of Artificial Sequence: Synthetic oligonucleotide"
uacuacgacaaagaagaucaugu

SEQ ID NO: 5193 - RNA, 21 nt, Artificial Sequence
  source: /note="Description of Artificial Sequence: Synthetic oligonucleotide"
ucuacgacaaagaagaucaug

SEQ ID NO: 5194 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucactacgacaaagaagaucaug

SEQ ID NO: 5195 - RNA, 21 nt, Artificial Sequence
  source: /note="Description of Artificial Sequence: Synthetic oligonucleotide"
ucuacgacaaagaagaucaug

SEQ ID NO: 5196 - RNA, 23 nt, Artificial Sequence
  source: /note="Description of Artificial Sequence: Synthetic oligonucleotide"
uucacuacgacaaagaagaucgu

SEQ ID NO: 5197 - RNA, 23 nt, Artificial Sequence
  source: /note="Description of Artificial Sequence: Synthetic oligonucleotide"
uucacuacgacaaagaagaucgu

SEQ ID NO: 5198 - RNA, 23 nt, Artificial Sequence
  source: /note="Description of Artificial Sequence: Synthetic oligonucleotide"
uucacuacgacaaagaagaucgu

SEQ ID NO: 5199 - RNA, 23 nt, Artificial Sequence
  source: /note="Description of Artificial Sequence: Synthetic oligonucleotide"
uucacuacgacaaagaagaucgu

SEQ ID NO: 5200 - RNA, 23 nt, Artificial Sequence
  source: /note="Description of Artificial Sequence: Synthetic oligonucleotide"
uucacuacgacaaagaagaucau

SEQ ID NO: 5201 - RNA, 23 nt, Artificial Sequence
  source: /note="Description of Artificial Sequence: Synthetic oligonucleotide"
uucacuacgacaaagaagaucgu

SEQ ID NO: 5202 - RNA, 23 nt, Artificial Sequence
  source: /note="Description of Artificial Sequence: Synthetic oligonucleotide"
uucacuacgacaaagaagaucgu

SEQ ID NO: 5203 - RNA, 23 nt, Artificial Sequence
  source: /note="Description of Artificial Sequence: Synthetic oligonucleotide"
uucacuacgacaaagaagaucgu

SEQ ID NO: 5204 - RNA, 23 nt, Artificial Sequence
  source: /note="Description of Artificial Sequence: Synthetic oligonucleotide"
uucacuacgacaaagaagaucgu

SEQ ID NO: 5205 - RNA, 23 nt, Artificial Sequence
  source: /note="Description of Artificial Sequence: Synthetic oligonucleotide"
uucacuacgacaaagaagaucgu

SEQ ID NO: 5206 - RNA, 23 nt, Artificial Sequence
  source: /note="Description of Artificial Sequence: Synthetic oligonucleotide"
uucacuacgacaaagaagaucgu

SEQ ID NO: 5207 - RNA, 23 nt, Artificial Sequence
  source: /note="Description of Artificial Sequence: Synthetic oligonucleotide"
uucacuacgacaaagaagaucgu

SEQ ID NO: 5208 - RNA, 23 nt, Artificial Sequence
  source: /note="Description of Artificial Sequence: Synthetic oligonucleotide"
uucacuacgacaaagaagaucgu

SEQ ID NO: 5209 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uaucactacgacaaagaagaucg

SEQ ID NO: 5210 - RNA, 21 nt, Artificial Sequence
  source: /note="Description of Artificial Sequence: Synthetic oligonucleotide"
uucacuacgacaaagaagauc

SEQ ID NO: 5211 - RNA, 21 nt, Artificial Sequence
  source: /note="Description of Artificial Sequence: Synthetic oligonucleotide"
uucacuacgacaaagaagauc

SEQ ID NO: 5212 - RNA, 23 nt, Artificial Sequence
  source: /note="Description of Artificial Sequence: Synthetic oligonucleotide"
uaaucacuacgacaaagaagauc

SEQ ID NO: 5213 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uaaatcacuacgacaaagaaggu

SEQ ID NO: 5214 - RNA, 23 nt, Artificial Sequence
  source: /note="Description of Artificial Sequence: Synthetic oligonucleotide"
uaaaaucacuacgacaaagaagg

SEQ ID NO: 5215 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugaaaatcacuacgacaaagagg

SEQ ID NO: 5216 - RNA, 23 nt, Artificial Sequence
  source: /note="Description of Artificial Sequence: Synthetic oligonucleotide"
uugcaagaucuacaaaaggaucc

SEQ ID NO: 5217 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uuugcaagauctacaaaaggauc

SEQ ID NO: 5218 - RNA, 23 nt, Artificial Sequence
  source: /note="Description of Artificial Sequence: Synthetic oligonucleotide"
uauugcaagaucuacaaaagggu

SEQ ID NO: 5219 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uaautgcaagaucuacaaaaggg

SEQ ID NO: 5220 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uuaatugcaagaucuacaaagcc

SEQ ID NO: 5221 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uuaatugcaagaucuacaaaagg

SEQ ID NO: 5222 - RNA, 23 nt, Artificial Sequence
  source: /note="Description of Artificial Sequence: Synthetic oligonucleotide"
uguaauugcaagaucuacaaagg

SEQ ID NO: 5223 - RNA, 23 nt, Artificial Sequence
  source: /note="Description of Artificial Sequence: Synthetic oligonucleotide"
uguaauugcaagaucuacaaaag

SEQ ID NO: 5224 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uguaautgcaagaucuacaaagg

SEQ ID NO: 5225 - RNA, 23 nt, Artificial Sequence
  source: /note="Description of Artificial Sequence: Synthetic oligonucleotide"
uguaauugcaagaucuacaaagg

SEQ ID NO: 5226 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uguaautgcaagaucuacaaagg

SEQ ID NO: 5227 - RNA, 23 nt, Artificial Sequence
  source: /note="Description of Artificial Sequence: Synthetic oligonucleotide"
uguaauugcaagaucuacaaagg

SEQ ID NO: 5228 - RNA, 23 nt, Artificial Sequence
  source: /note="Description of Artificial Sequence: Synthetic oligonucleotide"
ugguaauugcaagaucuacaagg

SEQ ID NO: 5229 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uuggtaauugcaagaucuacagg

SEQ ID NO: 5230 - RNA, 23 nt, Artificial Sequence
  source: /note="Description of Artificial Sequence: Synthetic oligonucleotide"
uaugguaauugcaagaucuacgg

SEQ ID NO: 5231 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uaauggtaauugcaagaucuacg

SEQ ID NO: 5232 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uaaatgguaauugcaagaucugc

SEQ ID NO: 5233 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uaaatgguaautgcaagaucugc

SEQ ID NO: 5234 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uggutuguuucacauaauuuauu

SEQ ID NO: 5235 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uaagguuuguutcacauaauuug

SEQ ID NO: 5236 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uuaaggtuugutucacauaauuu

SEQ ID NO: 5237 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uuaaggtuuguuucacauaauuu

SEQ ID NO: 5238 - RNA, 23 nt, Artificial Sequence
  source: /note="Description of Artificial Sequence: Synthetic oligonucleotide"
uguaagguuuguuucacauaauu

SEQ ID NO: 5239 - RNA, 23 nt, Artificial Sequence
  source: /note="Description of Artificial Sequence: Synthetic oligonucleotide"
ucguaagguuuguuucacauaau

SEQ ID NO: 5240 - RNA, 23 nt, Artificial Sequence
  source: /note="Description of Artificial Sequence: Synthetic oligonucleotide"
ucguaagguuuguuucacauagu

SEQ ID NO: 5241 - RNA, 23 nt, Artificial Sequence
  source: /note="Description of Artificial Sequence: Synthetic oligonucleotide"
ucguaaaguuuguuucacauagu

SEQ ID NO: 5242 - RNA, 23 nt, Artificial Sequence
  source: /note="Description of Artificial Sequence: Synthetic oligonucleotide"
ucguaagguuuguuucacauagu

SEQ ID NO: 5243 - RNA, 23 nt, Artificial Sequence
  source: /note="Description of Artificial Sequence: Synthetic oligonucleotide"
ucguaagguuuguuucacauagu

SEQ ID NO: 5244 - RNA, 23 nt, Artificial Sequence
  source: /note="Description of Artificial Sequence: Synthetic oligonucleotide"
ucguaagguuuguuucacauaau

SEQ ID NO: 5245 - RNA, 23 nt, Artificial Sequence
  source: /note="Description of Artificial Sequence: Synthetic oligonucleotide"
ucguaagguuuguuucacauagu

SEQ ID NO: 5246 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uacgtaagguuuguuucacaugg

SEQ ID NO: 5247 - RNA, 23 nt, Artificial Sequence
  source: /note="Description of Artificial Sequence: Synthetic oligonucleotide"
uacguaagguuuguuucacauaa

SEQ ID NO: 5248 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uacgtaagguuuguuucacaugg

SEQ ID NO: 5249 - RNA, 23 nt, Artificial Sequence
  source: /note="Description of Artificial Sequence: Synthetic oligonucleotide"
uacguaagguuuguuucacauaa

SEQ ID NO: 5250 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uacgtaagguuuguuucacaugg

SEQ ID NO: 5251 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uacgtaagguutguuucacaugg

SEQ ID NO: 5252 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uacgtaagguutguuucacaugg

SEQ ID NO: 5253 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uacgtaagguutguuucacaugg

SEQ ID NO: 5254 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucacguaaggutuguuucacaug

SEQ ID NO: 5255 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uacgtaagguuuguuucacgu

SEQ ID NO: 5256 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uucacgtaaggtuuguuucacgu

SEQ ID NO: 5257 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uucacgtaagguuuguuucacgu

SEQ ID NO: 5258 - RNA, 23 nt, Artificial Sequence
  source: /note="Description of Artificial Sequence: Synthetic oligonucleotide"
uuucacguaagguuuguuucaca

SEQ ID NO: 5259 - RNA, 23 nt, Artificial Sequence
  source: /note="Description of Artificial Sequence: Synthetic oligonucleotide"
uauucacguaagguuuguuucac

SEQ ID NO: 5260 - RNA, 23 nt, Artificial Sequence
  source: /note="Description of Artificial Sequence: Synthetic oligonucleotide"
uauucacguaagguuuguuucac

SEQ ID NO: 5261 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uaautcacugaagguuuguuucg

SEQ ID NO: 5262 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uaugtuguaaaauauaucacagu

SEQ ID NO: 5263 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uaugtuguaaaauauaucacagu

SEQ ID NO: 5264 - RNA, 23 nt, Artificial Sequence
  source: /note="Description of Artificial Sequence: Synthetic oligonucleotide"
ugauguuguaaaauauaucacgg

SEQ ID NO: 5265 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uggatguuguaaaauauaucacg

SEQ ID NO: 5266 - RNA, 23 nt, Artificial Sequence
  source: /note="Description of Artificial Sequence: Synthetic oligonucleotide"
ucggauguuguaaaauauaucgc

SEQ ID NO: 5267 - RNA, 23 nt, Artificial Sequence
  source: /note="Description of Artificial Sequence: Synthetic oligonucleotide"
ucggauguuguaaaauauaucgc

SEQ ID NO: 5268 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uacggatguugtaaaauauaucg

SEQ ID NO: 5269 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uacggatguuguaaaauauaucg

SEQ ID NO: 5270 - RNA, 23 nt, Artificial Sequence
  source: /note="Description of Artificial Sequence: Synthetic oligonucleotide"
uaacggauguuguaaaauauacc

SEQ ID NO: 5271 - RNA, 23 nt, Artificial Sequence
  source: /note="Description of Artificial Sequence: Synthetic oligonucleotide"
uaacggauguuguaaaauauauc

SEQ ID NO: 5272 - RNA, 23 nt, Artificial Sequence
  source: /note="Description of Artificial Sequence: Synthetic oligonucleotide"
uaacggauguuguaaaauauacc

SEQ ID NO: 5273 - RNA, 23 nt, Artificial Sequence
  source: /note="Description of Artificial Sequence: Synthetic oligonucleotide"
uaacggauguuguaaaauauacc

SEQ ID NO: 5274 - RNA, 23 nt, Artificial Sequence
  source: /note="Description of Artificial Sequence: Synthetic oligonucleotide"
uaacggauguuguaaaauauauc

SEQ ID NO: 5275 - RNA, 23 nt, Artificial Sequence
  source: /note="Description of Artificial Sequence: Synthetic oligonucleotide"
uaacggauguuguaaaauauauc

SEQ ID NO: 5276 - RNA, 23 nt, Artificial Sequence
  source: /note="Description of Artificial Sequence: Synthetic oligonucleotide"
uaacggauguuguaaaauauauc

SEQ ID NO: 5277 - RNA, 23 nt, Artificial Sequence
  source: /note="Description of Artificial Sequence: Synthetic oligonucleotide"
uaacggauguuguaaaauauauc

SEQ ID NO: 5278 - RNA, 23 nt, Artificial Sequence
  source: /note="Description of Artificial Sequence: Synthetic oligonucleotide"
uaacggauguuguaaaauauauc

SEQ ID NO: 5279 - RNA, 23 nt, Artificial Sequence
  source: /note="Description of Artificial Sequence: Synthetic oligonucleotide"
uuaacggauguuguaaaauaugu

SEQ ID NO: 5280 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uuaacggaugutguaaaauaugu

SEQ ID NO: 5281 - RNA, 21 nt, Artificial Sequence
  source: /note="Description of Artificial Sequence: Synthetic oligonucleotide"
uaacggauguuguaaaauaug

SEQ ID NO: 5282 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uauaacggaugtuguaaaauaug

SEQ ID NO: 5283 - RNA, 21 nt, Artificial Sequence
  source: /note="Description of Artificial Sequence: Synthetic oligonucleotide"
uaacggauguuguaaaauaug

SEQ ID NO: 5284 - RNA, 23 nt, Artificial Sequence
  source: /note="Description of Artificial Sequence: Synthetic oligonucleotide"
uaauaacggauguuguaaaaugu

SEQ ID NO: 5285 - RNA, 23 nt, Artificial Sequence
  source: /note="Description of Artificial Sequence: Synthetic oligonucleotide"
uaauaacggauguuguaaaaugu

SEQ ID NO: 5286 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uuaataacggatguuguaaaaug

SEQ ID NO: 5287 - RNA, 23 nt, Artificial Sequence
  source: /note="Description of Artificial Sequence: Synthetic oligonucleotide"
uguaauaacggauguuguaaagu

SEQ ID NO: 5288 - RNA, 23 nt, Artificial Sequence
  source: /note="Description of Artificial Sequence: Synthetic oligonucleotide"
ugcuaagaagaaauuguguuguu

SEQ ID NO: 5289 - RNA, 23 nt, Artificial Sequence
  source: /note="Description of Artificial Sequence: Synthetic oligonucleotide"
ugcuaagaagaaauuguguuguu

SEQ ID NO: 5290 - RNA, 23 nt, Artificial Sequence
  source: /note="Description of Artificial Sequence: Synthetic oligonucleotide"
ugcuaagaagaaauuguguugcc

SEQ ID NO: 5291 - RNA, 23 nt, Artificial Sequence
  source: /note="Description of Artificial Sequence: Synthetic oligonucleotide"
ugcuaagaagaaauuguguugcc

SEQ ID NO: 5292 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugcuaagaagaaatuguguuguu

SEQ ID NO: 5293 - RNA, 21 nt, Artificial Sequence
  source: /note="Description of Artificial Sequence: Synthetic oligonucleotide"
ugcuaagaagaaauuguguug

SEQ ID NO: 5294 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucagtaggaacacuugaagccgg

SEQ ID NO: 5295 - RNA, 23 nt, Artificial Sequence
  source: /note="Description of Artificial Sequence: Synthetic oligonucleotide"
uacaguaggaacacuugaagccg

SEQ ID NO: 5296 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugacagtaggaacacuugaagcc

SEQ ID NO: 5297 - RNA, 23 nt, Artificial Sequence
  source: /note="Description of Artificial Sequence: Synthetic oligonucleotide"
uugacaguaggaacacuugaagc

SEQ ID NO: 5298 - RNA, 23 nt, Artificial Sequence
  source: /note="Description of Artificial Sequence: Synthetic oligonucleotide"
uugacaguaggaacacuugaagc

SEQ ID NO: 5299 - RNA, 23 nt, Artificial Sequence
  source: /note="Description of Artificial Sequence: Synthetic oligonucleotide"
uaugacaguaggaacacuugagg

SEQ ID NO: 5300 - RNA, 23 nt, Artificial Sequence
  source: /note="Description of Artificial Sequence: Synthetic oligonucleotide"
uaugacaguaggaacacuugagg

SEQ ID NO: 5301 - RNA, 23 nt, Artificial Sequence
  source: /note="Description of Artificial Sequence: Synthetic oligonucleotide"
ucaugacaguaggaacacuugcc

SEQ ID NO: 5302 - RNA, 23 nt, Artificial Sequence
  source: /note="Description of Artificial Sequence: Synthetic oligonucleotide"
ucaugacaguaggaacacuuggg

SEQ ID NO: 5303 - RNA, 23 nt, Artificial Sequence
  source: /note="Description of Artificial Sequence: Synthetic oligonucleotide"
ucaugacaguaggaacacuugaa

SEQ ID NO: 5304 - RNA, 23 nt, Artificial Sequence
  source: /note="Description of Artificial Sequence: Synthetic oligonucleotide"
ucaugacaguaggaacacuugaa

SEQ ID NO: 5305 - RNA, 23 nt, Artificial Sequence
  source: /note="Description of Artificial Sequence: Synthetic oligonucleotide"
ucaugacaguaggaacacuuggg

SEQ ID NO: 5306 - RNA, 23 nt, Artificial Sequence
  source: /note="Description of Artificial Sequence: Synthetic oligonucleotide"
ucaugacaguaggaacacuuggg

SEQ ID NO: 5307 - RNA, 23 nt, Artificial Sequence
  source: /note="Description of Artificial Sequence: Synthetic oligonucleotide"
ucaugacaguaggaacacuuggg

SEQ ID NO: 5308 - RNA, 23 nt, Artificial Sequence
  source: /note="Description of Artificial Sequence: Synthetic oligonucleotide"
ucaugacaguaggaacacuugcc

SEQ ID NO: 5309 - RNA, 23 nt, Artificial Sequence
  source: /note="Description of Artificial Sequence: Synthetic oligonucleotide"
ucaugacaguaggaacacuuggg

SEQ ID NO: 5310 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uucatgacaguaggaacacuugg

SEQ ID NO: 5311 - RNA, 21 nt, Artificial Sequence
  source: /note="Description of Artificial Sequence: Synthetic oligonucleotide"
ucaugacaguaggaacacuug

SEQ ID NO: 5312 - RNA, 21 nt, Artificial Sequence
  source: /note="Description of Artificial Sequence: Synthetic oligonucleotide"
ucaugacaguaggaacacuug

SEQ ID NO: 5313 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugucaugacagtaggaacacuug

SEQ ID NO: 5314 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uggucatgacaguaggaacacuu

SEQ ID NO: 5315 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uaggtcaugacaguaggaacacu

SEQ ID NO: 5316 - RNA, 23 nt, Artificial Sequence
  source: /note="Description of Artificial Sequence: Synthetic oligonucleotide"
ucaggucaugacaguaggaacgc

SEQ ID NO: 5317 - RNA, 23 nt, Artificial Sequence
  source: /note="Description of Artificial Sequence: Synthetic oligonucleotide"
ugcaaacuagguaacuaucaaaa

SEQ ID NO: 5318 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugcaaacuaggtaacuaucaagg

SEQ ID NO: 5319 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugcaaacuaggtaacuaucaagg

SEQ ID NO: 5320 - RNA, 23 nt, Artificial Sequence
  source: /note="Description of Artificial Sequence: Synthetic oligonucleotide"
ugcaaacuagguaacuaucaaaa

SEQ ID NO: 5321 - RNA, 23 nt, Artificial Sequence
  source: /note="Description of Artificial Sequence: Synthetic oligonucleotide"
ugcaaacuagguaacuaucaagg

SEQ ID NO: 5322 - RNA, 23 nt, Artificial Sequence
  source: /note="Description of Artificial Sequence: Synthetic oligonucleotide"
ugcaaacuagguaacuaucaagg

SEQ ID NO: 5323 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugcaaacuaggtaacuaucaagg

SEQ ID NO: 5324 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugcaaatuagguaacuaucaagg

SEQ ID NO: 5325 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugcaaacuaggtaacuaucaagg

SEQ ID NO: 5326 - RNA, 23 nt, Artificial Sequence
  source: /note="Description of Artificial Sequence: Synthetic oligonucleotide"
ugcaaacuagguaacuaucaagg

SEQ ID NO: 5327 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugcaaacuaggtaacuaucgg

SEQ ID NO: 5328 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugcaaacuaggtaacuaucgg

SEQ ID NO: 5329 - RNA, 21 nt, Artificial Sequence
  source: /note="Description of Artificial Sequence: Synthetic oligonucleotide"
ugcaaacuagguaacuaucgg

SEQ ID NO: 5330 - RNA, 21 nt, Artificial Sequence
  source: /note="Description of Artificial Sequence: Synthetic oligonucleotide"
ugucgaguacacuuuuacuga

SEQ ID NO: 5331 - RNA, 21 nt, Artificial Sequence
  source: /note="Description of Artificial Sequence: Synthetic oligonucleotide"
ugucgaguacacuuuuacuga

SEQ ID NO: 5332 - RNA, 19 nt, Artificial Sequence
  source: /note="Description of Artificial Sequence: Synthetic oligonucleotide"
ucgaguacacuuuuacuga

SEQ ID NO: 5333 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uguaggagaatucacuuuuca

SEQ ID NO: 5334 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uguaggagaauucacuuuuca

SEQ ID NO: 5335 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aagggaaaacaaucuuccgua

SEQ ID NO: 5336 - RNA, 21 nt, Artificial Sequence
  source: /note="Description of Artificial Sequence: Synthetic oligonucleotide"
aagggaaaacaaucuuccgua

SEQ ID NO: 5337 - RNA, 21 nt, Artificial Sequence
  source: /note="Description of Artificial Sequence: Synthetic oligonucleotide"
agggaaaacaaucuuccguua

SEQ ID NO: 5338 - RNA, 21 nt, Artificial Sequence
  source: /note="Description of Artificial Sequence: Synthetic oligonucleotide"
gaaaacaaucuuccguuucaa

SEQ ID NO: 5339 - RNA, 21 nt, Artificial Sequence
  source: /note="Description of Artificial Sequence: Synthetic oligonucleotide"
aaaacaaucuuccguuucaaa

SEQ ID NO: 5340 - RNA, 21 nt, Artificial Sequence
  source: /note="Description of Artificial Sequence: Synthetic oligonucleotide"
agcauaaauguuuucgaaaua

SEQ ID NO: 5341 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gaagcauaaauguuuucgaaa

SEQ ID NO: 5342 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aagcauaaauguuuucgaaaa

SEQ ID NO: 5343 - RNA, 21 nt, Artificial Sequence
  source: /note="Description of Artificial Sequence: Synthetic oligonucleotide"
agcauaaauguuuucgaaaua

SEQ ID NO: 5344 - RNA, 21 nt, Artificial Sequence
  source: /note="Description of Artificial Sequence: Synthetic oligonucleotide"
augaucuucuuugucguagua

SEQ ID NO: 5345 - DNA, 19 bp, Artificial Sequence
  source: /note="Description of Artificial Sequence: Synthetic oligonucleotide"
  source: /note="Description of Combined DNA/RNA Molecule: Synthetic oligonucleotide"
ucuucuuugucguagugaa

SEQ ID NO: 5346 - RNA, 23 nt, Artificial Sequence
  source: /note="Description of Artificial Sequence: Synthetic oligonucleotide"
ucaguaaaaguguacucgacauu

SEQ ID NO: 5347 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucagtaaaaguguacucgacauu

SEQ ID NO: 5348 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucagtaaaaguguacucgacg

SEQ ID NO: 5349 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugaaaagugaatucuccuacaca

SEQ ID NO: 5350 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugaaaagugaatucuccuacacg

SEQ ID NO: 5351 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uacggaagauugututcccuuug

SEQ ID NO: 5352 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uacggaagauuguuutcccuuug

SEQ ID NO: 5353 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uaacggaagauuguuuucccuuu

SEQ ID NO: 5354 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uugaaacggaagauuguuuuccc

SEQ ID NO: 5355 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uuugaaacggaagauuguuuucc

SEQ ID NO: 5356 - RNA, 23 nt, Artificial Sequence
  source: /note="Description of Artificial Sequence: Synthetic oligonucleotide"
uauuucgaaaacauuuaugcuuc

SEQ ID NO: 5357 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uuucgaaaacatuuaugcuucag

SEQ ID NO: 5358 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uuuucgaaaacauuuaugcuucg

SEQ ID NO: 5359 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uauutcgaaaacauuuaugcucc

SEQ ID NO: 5360 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uacuacgacaaagaagaucaugu

SEQ ID NO: 5361 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uucacuacgacaaagaagauc

SEQ ID NO: 5362 - RNA, 23 nt, Homo sapiens
aaugucgaguacacuuuuacugg

SEQ ID NO: 5363 - RNA, 23 nt, Homo sapiens
aaugucgaguacacuuuuacugg

SEQ ID NO: 5364 - RNA, 21 nt, Homo sapiens
ugucgaguacacuuuuacugg

SEQ ID NO: 5365 - RNA, 23 nt, Homo sapiens
uguguaggagaauucacuuuucu

SEQ ID NO: 5366 - RNA, 23 nt, Homo sapiens
uguguaggagaauucacuuuucu

SEQ ID NO: 5367 - RNA, 23 nt, Homo sapiens
caaagggaaaacaaucuuccguu

SEQ ID NO: 5368 - RNA, 23 nt, Homo sapiens
caaagggaaaacaaucuuccguu

SEQ ID NO: 5369 - RNA, 23 nt, Homo sapiens
aaagggaaaacaaucuuccguuu

SEQ ID NO: 5370 - RNA, 23 nt, Homo sapiens
gggaaaacaaucuuccguuucaa

SEQ ID NO: 5371 - RNA, 23 nt, Homo sapiens
ggaaaacaaucuuccguuucaau

SEQ ID NO: 5372 - RNA, 23 nt, Homo sapiens
gaagcauaaauguuuucgaaauu

SEQ ID NO: 5373 - RNA, 23 nt, Homo sapiens
cugaagcauaaauguuuucgaaa

SEQ ID NO: 5374 - RNA, 23 nt, Homo sapiens
ugaagcauaaauguuuucgaaau

SEQ ID NO: 5375 - RNA, 23 nt, Homo sapiens
gaagcauaaauguuuucgaaauu

SEQ ID NO: 5376 - RNA, 23 nt, Homo sapiens
acaugaucuucuuugucguagug

SEQ ID NO: 5377 - RNA, 21 nt, Homo sapiens
gaucuucuuugucguagugau

SEQ ID NO: 5378 - RNA, 21 nt, Artificial Sequence
  source: /note="Description of Artificial Sequence: Synthetic oligonucleotide"
ugucgaguacacuuuuacuga

SEQ ID NO: 5379 - RNA, 21 nt, Artificial Sequence
  source: /note="Description of Artificial Sequence: Synthetic oligonucleotide"
ugucgaguacacuuuuacuga

SEQ ID NO: 5380 - RNA, 19 nt, Artificial Sequence
  source: /note="Description of Artificial Sequence: Synthetic oligonucleotide"
ucgaguacacuuuuacuga

SEQ ID NO: 5381 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uguaggagaatucacuuuuca

SEQ ID NO: 5382 - RNA, 21 nt, Artificial Sequence
  source: /note="Description of Artificial Sequence: Synthetic oligonucleotide"
uguaggagaauucacuuuuca

SEQ ID NO: 5383 - RNA, 21 nt, Artificial Sequence
  source: /note="Description of Artificial Sequence: Synthetic oligonucleotide"
aagggaaaacaaucuuccgua

SEQ ID NO: 5384 - RNA, 21 nt, Artificial Sequence
  source: /note="Description of Artificial Sequence: Synthetic oligonucleotide"
aagggaaaacaaucuuccgua

SEQ ID NO: 5385 - RNA, 21 nt, Artificial Sequence
  source: /note="Description of Artificial Sequence: Synthetic oligonucleotide"
agggaaaacaaucuuccguua

SEQ ID NO: 5386 - RNA, 21 nt, Artificial Sequence
  source: /note="Description of Artificial Sequence: Synthetic oligonucleotide"
gaaaacaaucuuccguuucaa

SEQ ID NO: 5387 - RNA, 21 nt, Artificial Sequence
  source: /note="Description of Artificial Sequence: Synthetic oligonucleotide"
aaaacaaucuuccguuucaaa

SEQ ID NO: 5388 - RNA, 21 nt, Artificial Sequence
  source: /note="Description of Artificial Sequence: Synthetic oligonucleotide"
agcauaaauguuuucgaaaua

SEQ ID NO: 5389 - RNA, 21 nt, Artificial Sequence
  source: /note="Description of Artificial Sequence: Synthetic oligonucleotide"
gaagcauaaauguuuucgaaa

SEQ ID NO: 5390 - RNA, 21 nt, Artificial Sequence
  source: /note="Description of Artificial Sequence: Synthetic oligonucleotide"
aagcauaaauguuuucgaaaa

SEQ ID NO: 5391 - RNA, 21 nt, Artificial Sequence
  source: /note="Description of Artificial Sequence: Synthetic oligonucleotide"
agcauaaauguuuucgaaaua

SEQ ID NO: 5392 - RNA, 21 nt, Artificial Sequence
  source: /note="Description of Artificial Sequence: Synthetic oligonucleotide"
augaucuucuuugucguagua

SEQ ID NO: 5393 - RNA, 19 nt, Artificial Sequence
  source: /note="Description of Artificial Sequence: Synthetic oligonucleotide"
ucuucuuugucguagugaa

SEQ ID NO: 5394 - RNA, 23 nt, Artificial Sequence
  source: /note="Description of Artificial Sequence: Synthetic oligonucleotide"
ucaguaaaaguguacucgacauu

SEQ ID NO: 5395 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucagtaaaaguguacucgacauu

SEQ ID NO: 5396 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucagtaaaaguguacucgacg

SEQ ID NO: 5397 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugaaaagugaatucuccuacaca

SEQ ID NO: 5398 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugaaaagugaatucuccuacacg

SEQ ID NO: 5399 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uacggaagauugututcccuuug

SEQ ID NO: 5400 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uacggaagauuguuutcccuuug

SEQ ID NO: 5401 - RNA, 23 nt, Artificial Sequence
  source: /note="Description of Artificial Sequence: Synthetic oligonucleotide"
uaacggaagauuguuuucccuuu

SEQ ID NO: 5402 - RNA, 23 nt, Artificial Sequence
  source: /note="Description of Artificial Sequence: Synthetic oligonucleotide"
uugaaacggaagauuguuuuccc

SEQ ID NO: 5403 - RNA, 23 nt, Artificial Sequence
  source: /note="Description of Artificial Sequence: Synthetic oligonucleotide"
uuugaaacggaagauuguuuucc

SEQ ID NO: 5404 - RNA, 23 nt, Artificial Sequence
  source: /note="Description of Artificial Sequence: Synthetic oligonucleotide"
uauuucgaaaacauuuaugcuuc

SEQ ID NO: 5405 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uuucgaaaacatuuaugcuucag

SEQ ID NO: 5406 - RNA, 23 nt, Artificial Sequence
  source: /note="Description of Artificial Sequence: Synthetic oligonucleotide"
uuuucgaaaacauuuaugcuucg

SEQ ID NO: 5407 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uauutcgaaaacauuuaugcucc

SEQ ID NO: 5408 - RNA, 23 nt, Artificial Sequence
  source: /note="Description of Artificial Sequence: Synthetic oligonucleotide"
uacuacgacaaagaagaucaugu

SEQ ID NO: 5409 - RNA, 21 nt, Artificial Sequence
  source: /note="Description of Artificial Sequence: Synthetic oligonucleotide"
uucacuacgacaaagaagauc

SEQ ID NO: 5410 - RNA, 21 nt, Artificial Sequence
  source: /note="Description of Artificial Sequence: Synthetic oligonucleotide"
caaguguuccuacugucauga

SEQ ID NO: 5411 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
caacacaatutcuucuuagca

SEQ ID NO: 5412 - RNA, 21 nt, Artificial Sequence
  source: /note="Description of Artificial Sequence: Synthetic oligonucleotide"
caacacaauuucuucuuagca

SEQ ID NO: 5413 - RNA, 21 nt, Artificial Sequence
  source: /note="Description of Artificial Sequence: Synthetic oligonucleotide"
ugucgaguacacuuuuacuga

SEQ ID NO: 5414 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uucuguguaggagaauucaca

SEQ ID NO: 5415 - RNA, 21 nt, Artificial Sequence
  source: /note="Description of Artificial Sequence: Synthetic oligonucleotide"
auaaauguuuucgaaauucaa

SEQ ID NO: 5416 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gaucuucuuugucguagugaa

SEQ ID NO: 5417 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gaucuucuuugucguagugaa

SEQ ID NO: 5418 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
caugaucutctuugucguaga

SEQ ID NO: 5419 - RNA, 21 nt, Artificial Sequence
  source: /note="Description of Artificial Sequence: Synthetic oligonucleotide"
caugaucuucuuugucguaga

SEQ ID NO: 5420 - RNA, 21 nt, Artificial Sequence
  source: /note="Description of Artificial Sequence: Synthetic oligonucleotide"
uuuguagaucuugcaauuaca

SEQ ID NO: 5421 - RNA, 21 nt, Artificial Sequence
  source: /note="Description of Artificial Sequence: Synthetic oligonucleotide"
uuuuguagaucuugcaauuaa

SEQ ID NO: 5422 - RNA, 21 nt, Artificial Sequence
  source: /note="Description of Artificial Sequence: Synthetic oligonucleotide"
guagaucuugcaauuaccaua

SEQ ID NO: 5423 - RNA, 21 nt, Artificial Sequence
  source: /note="Description of Artificial Sequence: Synthetic oligonucleotide"
uaugugaaacaaaccuuacga

SEQ ID NO: 5424 - RNA, 21 nt, Artificial Sequence
  source: /note="Description of Artificial Sequence: Synthetic oligonucleotide"
uuaugugaaacaaaccuuaca

SEQ ID NO: 5425 - RNA, 21 nt, Artificial Sequence
  source: /note="Description of Artificial Sequence: Synthetic oligonucleotide"
uaugugaaacaaaccuuacga

SEQ ID NO: 5426 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucaugacaguaggaacacuugcc

SEQ ID NO: 5427 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugcuaagaagaaatuguguuguu

SEQ ID NO: 5428 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugcuaagaagaaauuguguuguu

SEQ ID NO: 5429 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucagtaaaaguguactcgacauu

SEQ ID NO: 5430 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugugaauucuccuacacagaagc

SEQ ID NO: 5431 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uugaautucgaaaacauuuaugu

SEQ ID NO: 5432 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uucacuacgacaaagaagaucgu

SEQ ID NO: 5433 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uucacuacgacaaagaagaucgu

SEQ ID NO: 5434 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucuacgacaaagaagaucaugua

SEQ ID NO: 5435 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucuacgacaaagaagaucaugug

SEQ ID NO: 5436 - RNA, 23 nt, Artificial Sequence
  source: /note="Description of Artificial Sequence: Synthetic oligonucleotide"
uguaauugcaagaucuacaaaag

SEQ ID NO: 5437 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uuaatugcaagaucuacaaagcc

SEQ ID NO: 5438 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uaugguaauugcaagaucuacgg

SEQ ID NO: 5439 - RNA, 23 nt, Artificial Sequence
  source: /note="Description of Artificial Sequence: Synthetic oligonucleotide"
ucguaagguuuguuucacauaau

SEQ ID NO: 5440 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uguaagguuuguuucacauaauu

SEQ ID NO: 5441 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucguaagguuuguuucacauagu

SEQ ID NO: 5442 - RNA, 23 nt, Homo sapiens
uucaaguguuccuacugucauga

SEQ ID NO: 5443 - RNA, 23 nt, Homo sapiens
aacaacacaauuucuucuuagca

SEQ ID NO: 5444 - RNA, 23 nt, Homo sapiens
aacaacacaauuucuucuuagca

SEQ ID NO: 5445 - RNA, 23 nt, Homo sapiens
aaugucgaguacacuuuuacugg

SEQ ID NO: 5446 - RNA, 23 nt, Homo sapiens
gcuucuguguaggagaauucacu

SEQ ID NO: 5447 - RNA, 23 nt, Homo sapiens
gcauaaauguuuucgaaauucac

SEQ ID NO: 5448 - RNA, 23 nt, Homo sapiens
augaucuucuuugucguagugau

SEQ ID NO: 5449 - RNA, 23 nt, Homo sapiens
augaucuucuuugucguagugau

SEQ ID NO: 5450 - RNA, 23 nt, Homo sapiens
uacaugaucuucuuugucguagu

SEQ ID NO: 5451 - RNA, 23 nt, Homo sapiens
uacaugaucuucuuugucguagu

SEQ ID NO: 5452 - RNA, 23 nt, Homo sapiens
cuuuuguagaucuugcaauuacc

SEQ ID NO: 5453 - skipped

SEQ ID NO: 5454 - RNA, 23 nt, Homo sapiens
uuguagaucuugcaauuaccauu

SEQ ID NO: 5455 - RNA, 23 nt, Homo sapiens
auuaugugaaacaaaccuuacgu

SEQ ID NO: 5456 - RNA, 23 nt, Homo sapiens
aauuaugugaaacaaaccuuacg

SEQ ID NO: 5457 - RNA, 23 nt, Homo sapiens
auuaugugaaacaaaccuuacgu

SEQ ID NO: 5458 - RNA, 21 nt, Artificial Sequence
  source: /note="Description of Artificial Sequence: Synthetic oligonucleotide"
caaguguuccuacugucauga

SEQ ID NO: 5459 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
caacacaatutcuucuuagca

SEQ ID NO: 5460 - RNA, 21 nt, Artificial Sequence
  source: /note="Description of Artificial Sequence: Synthetic oligonucleotide"
caacacaauuucuucuuagca

SEQ ID NO: 5461 - RNA, 21 nt, Artificial Sequence
  source: /note="Description of Artificial Sequence: Synthetic oligonucleotide"
ugucgaguacacuuuuacuga

SEQ ID NO: 5462 - RNA, 21 nt, Artificial Sequence
  source: /note="Description of Artificial Sequence: Synthetic oligonucleotide"
uucuguguaggagaauucaca

SEQ ID NO: 5463 - RNA, 21 nt, Artificial Sequence
  source: /note="Description of Artificial Sequence: Synthetic oligonucleotide"
auaaauguuuucgaaauucaa

SEQ ID NO: 5464 - RNA, 21 nt, Artificial Sequence
  source: /note="Description of Artificial Sequence: Synthetic oligonucleotide"
gaucuucuuugucguagugaa

SEQ ID NO: 5465 - RNA, 21 nt, Artificial Sequence
  source: /note="Description of Artificial Sequence: Synthetic oligonucleotide"
gaucuucuuugucguagugaa

SEQ ID NO: 5466 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
caugaucutctuugucguaga

SEQ ID NO: 5467 - RNA, 21 nt, Artificial Sequence
  source: /note="Description of Artificial Sequence: Synthetic oligonucleotide"
caugaucuucuuugucguaga

SEQ ID NO: 5468 - RNA, 21 nt, Artificial Sequence
  source: /note="Description of Artificial Sequence: Synthetic oligonucleotide"
uuuguagaucuugcaauuaca

SEQ ID NO: 5469 - RNA, 21 nt, Artificial Sequence
  source: /note="Description of Artificial Sequence: Synthetic oligonucleotide"
uuuuguagaucuugcaauuaa

SEQ ID NO: 5470 - RNA, 21 nt, Artificial Sequence
  source: /note="Description of Artificial Sequence: Synthetic oligonucleotide"
guagaucuugcaauuaccaua

SEQ ID NO: 5471 - RNA, 21 nt, Artificial Sequence
  source: /note="Description of Artificial Sequence: Synthetic oligonucleotide"
uaugugaaacaaaccuuacga

SEQ ID NO: 5472 - RNA, 21 nt, Artificial Sequence
  source: /note="Description of Artificial Sequence: Synthetic oligonucleotide"
uuaugugaaacaaaccuuaca

SEQ ID NO: 5473 - RNA, 21 nt, Artificial Sequence
  source: /note="Description of Artificial Sequence: Synthetic oligonucleotide"
uaugugaaacaaaccuuacga

SEQ ID NO: 5474 - RNA, 23 nt, Artificial Sequence
  source: /note="Description of Artificial Sequence: Synthetic oligonucleotide"
ucaugacaguaggaacacuugcc

SEQ ID NO: 5475 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugcuaagaagaaatuguguuguu

SEQ ID NO: 5476 - RNA, 23 nt, Artificial Sequence
  source: /note="Description of Artificial Sequence: Synthetic oligonucleotide"
ugcuaagaagaaauuguguuguu

SEQ ID NO: 5477 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucagtaaaaguguactcgacauu

SEQ ID NO: 5478 - RNA, 23 nt, Artificial Sequence
  source: /note="Description of Artificial Sequence: Synthetic oligonucleotide"
ugugaauucuccuacacagaagc

SEQ ID NO: 5479 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uugaautucgaaaacauuuaugu

SEQ ID NO: 5480 - RNA, 23 nt, Artificial Sequence
  source: /note="Description of Artificial Sequence: Synthetic oligonucleotide"
uucacuacgacaaagaagaucgu

SEQ ID NO: 5481 - RNA, 23 nt, Artificial Sequence
  source: /note="Description of Artificial Sequence: Synthetic oligonucleotide"
uucacuacgacaaagaagaucgu

SEQ ID NO: 5482 - RNA, 23 nt, Artificial Sequence
  source: /note="Description of Artificial Sequence: Synthetic oligonucleotide"
ucuacgacaaagaagaucaugua

SEQ ID NO: 5483 - RNA, 23 nt, Artificial Sequence
  source: /note="Description of Artificial Sequence: Synthetic oligonucleotide"
ucuacgacaaagaagaucaugug

SEQ ID NO: 5484 - RNA, 23 nt, Artificial Sequence
  source: /note="Description of Artificial Sequence: Synthetic oligonucleotide"
uguaauugcaagaucuacaaaag

SEQ ID NO: 5485 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uuaatugcaagaucuacaaagcc

SEQ ID NO: 5486 - RNA, 23 nt, Artificial Sequence
  source: /note="Description of Artificial Sequence: Synthetic oligonucleotide"
uaugguaauugcaagaucuacgg

SEQ ID NO: 5487 - RNA, 23 nt, Artificial Sequence
  source: /note="Description of Artificial Sequence: Synthetic oligonucleotide"
ucguaagguuuguuucacauaau

SEQ ID NO: 5488 - RNA, 23 nt, Artificial Sequence
  source: /note="Description of Artificial Sequence: Synthetic oligonucleotide"
uguaagguuuguuucacauaauu

SEQ ID NO: 5489 - RNA, 23 nt, Artificial Sequence
  source: /note="Description of Artificial Sequence: Synthetic oligonucleotide"
ucguaagguuuguuucacauagu

SEQ ID NO: 5490 - RNA, 21 nt, Artificial Sequence
  source: /note="Description of Artificial Sequence: Synthetic oligonucleotide"
gcccaaaauacugauaauaga

SEQ ID NO: 5491 - RNA, 21 nt, Artificial Sequence
  source: /note="Description of Artificial Sequence: Synthetic oligonucleotide"
aagggaaaacaaucuuccgua

SEQ ID NO: 5492 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuuguagatctugcaauuaca

SEQ ID NO: 5493 - RNA, 21 nt, Artificial Sequence
  source: /note="Description of Artificial Sequence: Synthetic oligonucleotide"
augucgaguacacuuuuacua

SEQ ID NO: 5494 - RNA, 21 nt, Artificial Sequence
  source: /note="Description of Artificial Sequence: Synthetic oligonucleotide"
cuaaauuauggaaguaaucua

SEQ ID NO: 5495 - RNA, 21 nt, Artificial Sequence
  source: /note="Description of Artificial Sequence: Synthetic oligonucleotide"
ugagacugacacauuguaaua

SEQ ID NO: 5496 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aucuucuutgtcguagugaua

SEQ ID NO: 5497 - RNA, 21 nt, Artificial Sequence
  source: /note="Description of Artificial Sequence: Synthetic oligonucleotide"
ugguuucagcacagauucaga

SEQ ID NO: 5498 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acaugauctucuuugucguaa

SEQ ID NO: 5499 - RNA, 21 nt, Artificial Sequence
  source: /note="Description of Artificial Sequence: Synthetic oligonucleotide"
cuucugaaacauccaaacuga

SEQ ID NO: 5500 - RNA, 21 nt, Artificial Sequence
  source: /note="Description of Artificial Sequence: Synthetic oligonucleotide"
uauugugacuuuaaguuuaga

SEQ ID NO: 5501 - RNA, 21 nt, Artificial Sequence
  source: /note="Description of Artificial Sequence: Synthetic oligonucleotide"
caccuucuccuuaaaauucua

SEQ ID NO: 5502 - RNA, 21 nt, Artificial Sequence
  source: /note="Description of Artificial Sequence: Synthetic oligonucleotide"
uugugacuuuaaguuuaguga

SEQ ID NO: 5503 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gaucuucutugucguagugaa

SEQ ID NO: 5504 - RNA, 21 nt, Artificial Sequence
  source: /note="Description of Artificial Sequence: Synthetic oligonucleotide"
uugcuauaggaaauuugguca

SEQ ID NO: 5505 - RNA, 21 nt, Artificial Sequence
  source: /note="Description of Artificial Sequence: Synthetic oligonucleotide"
caugaucuucuuugucguaga

SEQ ID NO: 5506 - RNA, 21 nt, Artificial Sequence
  source: /note="Description of Artificial Sequence: Synthetic oligonucleotide"
uugauaguuaccuaguuugca

SEQ ID NO: 5507 - RNA, 21 nt, Artificial Sequence
  source: /note="Description of Artificial Sequence: Synthetic oligonucleotide"
uucuguguaggagaauucaca

SEQ ID NO: 5508 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugcuauaggaaauuuggucua

SEQ ID NO: 5509 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uucuguguaggagaauucaca

SEQ ID NO: 5510 - RNA, 21 nt, Artificial Sequence
  source: /note="Description of Artificial Sequence: Synthetic oligonucleotide"
ugauaguuaccuaguuugcaa

SEQ ID NO: 5511 - RNA, 21 nt, Artificial Sequence
  source: /note="Description of Artificial Sequence: Synthetic oligonucleotide"
guuugaacacaaaucuuucga

SEQ ID NO: 5512 - RNA, 21 nt, Artificial Sequence
  source: /note="Description of Artificial Sequence: Synthetic oligonucleotide"
gagauggauucucuucguuca

SEQ ID NO: 5513 - RNA, 21 nt, Artificial Sequence
  source: /note="Description of Artificial Sequence: Synthetic oligonucleotide"
augaucuucuuugucguagua

SEQ ID NO: 5514 - RNA, 21 nt, Artificial Sequence
  source: /note="Description of Artificial Sequence: Synthetic oligonucleotide"
agcuugaaguaaaauuagaca

SEQ ID NO: 5515 - RNA, 21 nt, Artificial Sequence
  source: /note="Description of Artificial Sequence: Synthetic oligonucleotide"
aucuucuuugucguagugaua

SEQ ID NO: 5516 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugaucuuctutgucguaguga

SEQ ID NO: 5517 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aucugagacugaauuugccga

SEQ ID NO: 5518 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
augaucuucutugucguagua

SEQ ID NO: 5519 - RNA, 21 nt, Artificial Sequence
  source: /note="Description of Artificial Sequence: Synthetic oligonucleotide"
caaguguuccuacugucauga

SEQ ID NO: 5520 - RNA, 21 nt, Artificial Sequence
  source: /note="Description of Artificial Sequence: Synthetic oligonucleotide"
augugaaacaaaccuuacgua

SEQ ID NO: 5521 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugucgaguacacuuuuacuga

SEQ ID NO: 5522 - RNA, 21 nt, Artificial Sequence
  source: /note="Description of Artificial Sequence: Synthetic oligonucleotide"
uguaggagaauucacuuuuca

SEQ ID NO: 5523 - RNA, 21 nt, Artificial Sequence
  source: /note="Description of Artificial Sequence: Synthetic oligonucleotide"
ggcguuguaguuccuaucuca

SEQ ID NO: 5524 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uauugugacutuaaguuuaga

SEQ ID NO: 5525 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uugugacutuaaguuuaguga

SEQ ID NO: 5526 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
caacacaatutcuucuuagca

SEQ ID NO: 5527 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aagggaaaacaaucuuccgua

SEQ ID NO: 5528 - RNA, 21 nt, Artificial Sequence
  source: /note="Description of Artificial Sequence: Synthetic oligonucleotide"
ugucgaguacacuuuuacuga

SEQ ID NO: 5529 - RNA, 21 nt, Artificial Sequence
  source: /note="Description of Artificial Sequence: Synthetic oligonucleotide"
gaucuucuuugucguagugaa

SEQ ID NO: 5530 - RNA, 21 nt, Artificial Sequence
  source: /note="Description of Artificial Sequence: Synthetic oligonucleotide"
agcauaaauguuuucgaaaua

SEQ ID NO: 5531 - RNA, 21 nt, Artificial Sequence
  source: /note="Description of Artificial Sequence: Synthetic oligonucleotide"
uaugugaaacaaaccuuacga

SEQ ID NO: 5532 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uguaggagaatucacuuuuca

SEQ ID NO: 5533 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
caugaucutctuugucguaga

SEQ ID NO: 5534 - RNA, 21 nt, Artificial Sequence
  source: /note="Description of Artificial Sequence: Synthetic oligonucleotide"
uucuguguaggagaauucaca

SEQ ID NO: 5535 - RNA, 21 nt, Artificial Sequence
  source: /note="Description of Artificial Sequence: Synthetic oligonucleotide"
uuuguagaucuugcaauuaca

SEQ ID NO: 5536 - RNA, 21 nt, Artificial Sequence
  source: /note="Description of Artificial Sequence: Synthetic oligonucleotide"
ugucgaguacacuuuuacuga

SEQ ID NO: 5537 - RNA, 19 nt, Artificial Sequence
  source: /note="Description of Artificial Sequence: Synthetic oligonucleotide"
ucgaguacacuuuuacuga

SEQ ID NO: 5538 - RNA, 21 nt, Artificial Sequence
  source: /note="Description of Artificial Sequence: Synthetic oligonucleotide"
caugaucuucuuugucguaga

SEQ ID NO: 5539 - RNA, 21 nt, Artificial Sequence
  source: /note="Description of Artificial Sequence: Synthetic oligonucleotide"
gaaaacaaucuuccauuucaa

SEQ ID NO: 5540 - RNA, 21 nt, Artificial Sequence
  source: /note="Description of Artificial Sequence: Synthetic oligonucleotide"
gaaaacaaucuuccguuucaa

SEQ ID NO: 5541 - RNA, 21 nt, Artificial Sequence
  source: /note="Description of Artificial Sequence: Synthetic oligonucleotide"
aaaacaaucuuccguuucaaa

SEQ ID NO: 5542 - RNA, 21 nt, Artificial Sequence
  source: /note="Description of Artificial Sequence: Synthetic oligonucleotide"
aaaacaaucuuccguuucaaa

SEQ ID NO: 5543 - RNA, 21 nt, Artificial Sequence
  source: /note="Description of Artificial Sequence: Synthetic oligonucleotide"
ggcuucuguguaggagaauua

SEQ ID NO: 5544 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uucuguguaggagaauucaca

SEQ ID NO: 5545 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
guguaggagaauucacuuuua

SEQ ID NO: 5546 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uguaggagaauucauuuuuca

SEQ ID NO: 5547 - RNA, 21 nt, Artificial Sequence
  source: /note="Description of Artificial Sequence: Synthetic oligonucleotide"
ggagaauucacuuuucuucga

SEQ ID NO: 5548 - RNA, 21 nt, Artificial Sequence
  source: /note="Description of Artificial Sequence: Synthetic oligonucleotide"
ggagaauucacuuuucuucga

SEQ ID NO: 5549 - RNA, 21 nt, Artificial Sequence
  source: /note="Description of Artificial Sequence: Synthetic oligonucleotide"
cugaagcauaaauguuuucga

SEQ ID NO: 5550 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugaagcauaaauguuuucgaa

SEQ ID NO: 5551 - RNA, 21 nt, Artificial Sequence
  source: /note="Description of Artificial Sequence: Synthetic oligonucleotide"
gaagcauaaauguuuucgaaa

SEQ ID NO: 5552 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gaagcauaaauguuuucgaaa

SEQ ID NO: 5553 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aagcauaaauguuuucgaaaa

SEQ ID NO: 5554 - RNA, 21 nt, Artificial Sequence
  source: /note="Description of Artificial Sequence: Synthetic oligonucleotide"
agcauaaauguuuucgaaaua

SEQ ID NO: 5555 - RNA, 21 nt, Artificial Sequence
  source: /note="Description of Artificial Sequence: Synthetic oligonucleotide"
agcauaaauguuuucgaaaua

SEQ ID NO: 5556 - RNA, 21 nt, Artificial Sequence
  source: /note="Description of Artificial Sequence: Synthetic oligonucleotide"
agcauaaauguuuucgaaaua

SEQ ID NO: 5557 - RNA, 21 nt, Artificial Sequence
  source: /note="Description of Artificial Sequence: Synthetic oligonucleotide"
agcauaaauguuuuugaaaua

SEQ ID NO: 5558 - RNA, 21 nt, Artificial Sequence
  source: /note="Description of Artificial Sequence: Synthetic oligonucleotide"
agcauaaauguuuucgaaaua

SEQ ID NO: 5559 - RNA, 19 nt, Artificial Sequence
  source: /note="Description of Artificial Sequence: Synthetic oligonucleotide"
cauaaauguuuucgaaaua

SEQ ID NO: 5560 - RNA, 21 nt, Artificial Sequence
  source: /note="Description of Artificial Sequence: Synthetic oligonucleotide"
agcauaaauguuuucgaaaua

SEQ ID NO: 5561 - RNA, 21 nt, Artificial Sequence
  source: /note="Description of Artificial Sequence: Synthetic oligonucleotide"
gcauaaauguuuucgaaauua

SEQ ID NO: 5562 - RNA, 21 nt, Artificial Sequence
  source: /note="Description of Artificial Sequence: Synthetic oligonucleotide"
auaaauguuuucgaaauucaa

SEQ ID NO: 5563 - RNA, 21 nt, Artificial Sequence
  source: /note="Description of Artificial Sequence: Synthetic oligonucleotide"
auaaauguuuucgaaauucaa

SEQ ID NO: 5564 - RNA, 21 nt, Artificial Sequence
  source: /note="Description of Artificial Sequence: Synthetic oligonucleotide"
uaaauguuuucgaaauucaca

SEQ ID NO: 5565 - RNA, 21 nt, Artificial Sequence
  source: /note="Description of Artificial Sequence: Synthetic oligonucleotide"
uacaugaucuucuuugucgua

SEQ ID NO: 5566 - RNA, 21 nt, Artificial Sequence
  source: /note="Description of Artificial Sequence: Synthetic oligonucleotide"
caugaucuucuuugucguaga

SEQ ID NO: 5567 - RNA, 21 nt, Artificial Sequence
  source: /note="Description of Artificial Sequence: Synthetic oligonucleotide"
caugaucuucuuugucguaga

SEQ ID NO: 5568 - RNA, 21 nt, Artificial Sequence
  source: /note="Description of Artificial Sequence: Synthetic oligonucleotide"
augaucuucuuugucguagua

SEQ ID NO: 5569 - RNA, 21 nt, Artificial Sequence
  source: /note="Description of Artificial Sequence: Synthetic oligonucleotide"
ugaucuucuuugucguaguga

SEQ ID NO: 5570 - DNA, 19 bp, Artificial Sequence
  source: /note="Description of Artificial Sequence: Synthetic oligonucleotide"
  source: /note="Description of Combined DNA/RNA Molecule: Synthetic oligonucleotide"
ucuucuuugucguagugaa

SEQ ID NO: 5571 - DNA, 19 bp, Artificial Sequence
  source: /note="Description of Artificial Sequence: Synthetic oligonucleotide"
  source: /note="Description of Combined DNA/RNA Molecule: Synthetic oligonucleotide"
ucuucuuugucguagugaa

SEQ ID NO: 5572 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gaucuucuuugucguagugaa

SEQ ID NO: 5573 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gaucuucuuugucguagugaa

SEQ ID NO: 5574 - RNA, 21 nt, Artificial Sequence
  source: /note="Description of Artificial Sequence: Synthetic oligonucleotide"
gaucuucuuugucguagugaa

SEQ ID NO: 5575 - RNA, 21 nt, Artificial Sequence
  source: /note="Description of Artificial Sequence: Synthetic oligonucleotide"
ucuuugucguagugauuuuca

SEQ ID NO: 5576 - RNA, 21 nt, Artificial Sequence
  source: /note="Description of Artificial Sequence: Synthetic oligonucleotide"
auccuuuuguagaucuugcaa

SEQ ID NO: 5577 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccuuuuguagaucuugcaaua

SEQ ID NO: 5578 - RNA, 21 nt, Artificial Sequence
  source: /note="Description of Artificial Sequence: Synthetic oligonucleotide"
cuuuuguagaucuugcaauua

SEQ ID NO: 5579 - RNA, 21 nt, Artificial Sequence
  source: /note="Description of Artificial Sequence: Synthetic oligonucleotide"
uuuuguagaucuugcaauuaa

SEQ ID NO: 5580 - RNA, 21 nt, Artificial Sequence
  source: /note="Description of Artificial Sequence: Synthetic oligonucleotide"
uuuuguagaucuugcaauuaa

SEQ ID NO: 5581 - RNA, 21 nt, Artificial Sequence
  source: /note="Description of Artificial Sequence: Synthetic oligonucleotide"
uuuguagaucuugcaauuaca

SEQ ID NO: 5582 - RNA, 21 nt, Artificial Sequence
  source: /note="Description of Artificial Sequence: Synthetic oligonucleotide"
uuuguagaucuugcaauuaca

SEQ ID NO: 5583 - RNA, 21 nt, Artificial Sequence
  source: /note="Description of Artificial Sequence: Synthetic oligonucleotide"
uuuguagaucuugcaauuaca

SEQ ID NO: 5584 - RNA, 21 nt, Artificial Sequence
  source: /note="Description of Artificial Sequence: Synthetic oligonucleotide"
uuguagaucuugcaauuacca

SEQ ID NO: 5585 - RNA, 21 nt, Artificial Sequence
  source: /note="Description of Artificial Sequence: Synthetic oligonucleotide"
guagaucuugcaauuaccaua

SEQ ID NO: 5586 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aauuaugugaaacaaaccuua

SEQ ID NO: 5587 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auuaugugaaacaaaccuuaa

SEQ ID NO: 5588 - RNA, 21 nt, Artificial Sequence
  source: /note="Description of Artificial Sequence: Synthetic oligonucleotide"
uuaugugaaacaaaccuuaca

SEQ ID NO: 5589 - RNA, 21 nt, Artificial Sequence
  source: /note="Description of Artificial Sequence: Synthetic oligonucleotide"
caugaucuucuuugucguaga

SEQ ID NO: 5590 - RNA, 21 nt, Artificial Sequence
  source: /note="Description of Artificial Sequence: Synthetic oligonucleotide"
gaaaacaaucuuccauuucaa

SEQ ID NO: 5591 - RNA, 21 nt, Artificial Sequence
  source: /note="Description of Artificial Sequence: Synthetic oligonucleotide"
gaaaacaaucuuccguuucaa

SEQ ID NO: 5592 - RNA, 21 nt, Artificial Sequence
  source: /note="Description of Artificial Sequence: Synthetic oligonucleotide"
aaaacaaucuuccguuucaaa

SEQ ID NO: 5593 - RNA, 21 nt, Artificial Sequence
  source: /note="Description of Artificial Sequence: Synthetic oligonucleotide"
ggcuucuguguaggagaauua

SEQ ID NO: 5594 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
guguaggagaauucacuuuua

SEQ ID NO: 5595 - RNA, 21 nt, Artificial Sequence
  source: /note="Description of Artificial Sequence: Synthetic oligonucleotide"
ggagaauucacuuuucuucga

SEQ ID NO: 5596 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugaagcauaaauguuuucgaa

SEQ ID NO: 5597 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gaagcauaaauguuuucgaaa

SEQ ID NO: 5598 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aagcauaaauguuuucgaaaa

SEQ ID NO: 5599 - RNA, 21 nt, Artificial Sequence
  source: /note="Description of Artificial Sequence: Synthetic oligonucleotide"
agcauaaauguuuucgaaaua

SEQ ID NO: 5600 - RNA, 21 nt, Artificial Sequence
  source: /note="Description of Artificial Sequence: Synthetic oligonucleotide"
agcauaaauguuuucgaaaua

SEQ ID NO: 5601 - RNA, 21 nt, Artificial Sequence
  source: /note="Description of Artificial Sequence: Synthetic oligonucleotide"
uaaauguuuucgaaauucaca

SEQ ID NO: 5602 - RNA, 21 nt, Artificial Sequence
  source: /note="Description of Artificial Sequence: Synthetic oligonucleotide"
caugaucuucuuugucguaga

SEQ ID NO: 5603 - RNA, 21 nt, Artificial Sequence
  source: /note="Description of Artificial Sequence: Synthetic oligonucleotide"
augaucuucuuugucguagua

SEQ ID NO: 5604 - RNA, 21 nt, Artificial Sequence
  source: /note="Description of Artificial Sequence: Synthetic oligonucleotide"
ugaucuucuuugucguaguga

SEQ ID NO: 5605 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gaucuucuuugucguagugaa

SEQ ID NO: 5606 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gaucuucuuugucguagugaa

SEQ ID NO: 5607 - RNA, 21 nt, Artificial Sequence
  source: /note="Description of Artificial Sequence: Synthetic oligonucleotide"
gaucuucuuugucguagugaa

SEQ ID NO: 5608 - RNA, 21 nt, Artificial Sequence
  source: /note="Description of Artificial Sequence: Synthetic oligonucleotide"
ucuuugucguagugauuuuca

SEQ ID NO: 5609 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccuuuuguagaucuugcaaua

SEQ ID NO: 5610 - RNA, 21 nt, Artificial Sequence
  source: /note="Description of Artificial Sequence: Synthetic oligonucleotide"
uuuguagaucuugcaauuaca

SEQ ID NO: 5611 - RNA, 21 nt, Artificial Sequence
  source: /note="Description of Artificial Sequence: Synthetic oligonucleotide"
guagaucuugcaauuaccaua

SEQ ID NO: 5612 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aauuaugugaaacaaaccuua

SEQ ID NO: 5613 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auuaugugaaacaaaccuuaa

SEQ ID NO: 5614 - RNA, 21 nt, Artificial Sequence
  source: /note="Description of Artificial Sequence: Synthetic oligonucleotide"
uuaugugaaacaaaccuuaca

SEQ ID NO: 5615 - RNA, 21 nt, Artificial Sequence
  source: /note="Description of Artificial Sequence: Synthetic oligonucleotide"
guagaucuugcaauuaccaua

SEQ ID NO: 5616 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aauuaugugaaacaaaccuua

SEQ ID NO: 5617 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auuaugugaaacaaaccuuaa

SEQ ID NO: 5618 - RNA, 21 nt, Artificial Sequence
  source: /note="Description of Artificial Sequence: Synthetic oligonucleotide"
uuaugugaaacaaaccuuaca

SEQ ID NO: 5619 - RNA, 21 nt, Artificial Sequence
  source: /note="Description of Artificial Sequence: Synthetic oligonucleotide"
caugaucuucuuugucguaga

SEQ ID NO: 5620 - RNA, 21 nt, Artificial Sequence
  source: /note="Description of Artificial Sequence: Synthetic oligonucleotide"
gaaaacaaucuuccauuucaa

SEQ ID NO: 5621 - RNA, 21 nt, Artificial Sequence
  source: /note="Description of Artificial Sequence: Synthetic oligonucleotide"
gaaaacaaucuuccguuucaa

SEQ ID NO: 5622 - RNA, 21 nt, Artificial Sequence
  source: /note="Description of Artificial Sequence: Synthetic oligonucleotide"
aaaacaaucuuccguuucaaa

SEQ ID NO: 5623 - RNA, 21 nt, Artificial Sequence
  source: /note="Description of Artificial Sequence: Synthetic oligonucleotide"
ggcuucuguguaggagaauua

SEQ ID NO: 5624 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
guguaggagaauucacuuuua

SEQ ID NO: 5625 - RNA, 21 nt, Artificial Sequence
  source: /note="Description of Artificial Sequence: Synthetic oligonucleotide"
ggagaauucacuuuucuucga

SEQ ID NO: 5626 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugaagcauaaauguuuucgaa

SEQ ID NO: 5627 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gaagcauaaauguuuucgaaa

SEQ ID NO: 5628 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aagcauaaauguuuucgaaaa

SEQ ID NO: 5629 - RNA, 21 nt, Artificial Sequence
  source: /note="Description of Artificial Sequence: Synthetic oligonucleotide"
agcauaaauguuuucgaaaua

SEQ ID NO: 5630 - RNA, 21 nt, Artificial Sequence
  source: /note="Description of Artificial Sequence: Synthetic oligonucleotide"
agcauaaauguuuucgaaaua

SEQ ID NO: 5631 - RNA, 21 nt, Artificial Sequence
  source: /note="Description of Artificial Sequence: Synthetic oligonucleotide"
uaaauguuuucgaaauucaca

SEQ ID NO: 5632 - RNA, 21 nt, Artificial Sequence
  source: /note="Description of Artificial Sequence: Synthetic oligonucleotide"
caugaucuucuuugucguaga

SEQ ID NO: 5633 - RNA, 21 nt, Artificial Sequence
  source: /note="Description of Artificial Sequence: Synthetic oligonucleotide"
augaucuucuuugucguagua

SEQ ID NO: 5634 - RNA, 21 nt, Artificial Sequence
  source: /note="Description of Artificial Sequence: Synthetic oligonucleotide"
ugaucuucuuugucguaguga

SEQ ID NO: 5635 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gaucuucuuugucguagugaa

SEQ ID NO: 5636 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gaucuucuuugucguagugaa

SEQ ID NO: 5637 - RNA, 21 nt, Artificial Sequence
  source: /note="Description of Artificial Sequence: Synthetic oligonucleotide"
gaucuucuuugucguagugaa

SEQ ID NO: 5638 - RNA, 21 nt, Artificial Sequence
  source: /note="Description of Artificial Sequence: Synthetic oligonucleotide"
ucuuugucguagugauuuuca

SEQ ID NO: 5639 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccuuuuguagaucuugcaaua

SEQ ID NO: 5640 - RNA, 21 nt, Artificial Sequence
  source: /note="Description of Artificial Sequence: Synthetic oligonucleotide"
uuuguagaucuugcaauuaca

SEQ ID NO: 5641 - RNA, 21 nt, Artificial Sequence
  source: /note="Description of Artificial Sequence: Synthetic oligonucleotide"
guagaucuugcaauuaccaua

SEQ ID NO: 5642 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aauuaugugaaacaaaccuua

SEQ ID NO: 5643 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auuaugugaaacaaaccuuaa

SEQ ID NO: 5644 - RNA, 21 nt, Artificial Sequence
  source: /note="Description of Artificial Sequence: Synthetic oligonucleotide"
uuaugugaaacaaaccuuaca

SEQ ID NO: 5645 - RNA, 23 nt, Artificial Sequence
  source: /note="Description of Artificial Sequence: Synthetic oligonucleotide"
ucuauuaucaguauuuugggcag

SEQ ID NO: 5646 - RNA, 23 nt, Artificial Sequence
  source: /note="Description of Artificial Sequence: Synthetic oligonucleotide"
uacggaagauuguuuucccuuug

SEQ ID NO: 5647 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uguaautgcaagatctacaaaag

SEQ ID NO: 5648 - RNA, 23 nt, Artificial Sequence
  source: /note="Description of Artificial Sequence: Synthetic oligonucleotide"
uaguaaaaguguacucgacauuu

SEQ ID NO: 5649 - RNA, 23 nt, Artificial Sequence
  source: /note="Description of Artificial Sequence: Synthetic oligonucleotide"
uagauuacuuccauaauuuagga

SEQ ID NO: 5650 - RNA, 23 nt, Artificial Sequence
  source: /note="Description of Artificial Sequence: Synthetic oligonucleotide"
uauuacaaugugucagucucaag

SEQ ID NO: 5651 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uaucactacgacaaagaagauca

SEQ ID NO: 5652 - RNA, 23 nt, Artificial Sequence
  source: /note="Description of Artificial Sequence: Synthetic oligonucleotide"
ucugaaucugugcugaaaccaca

SEQ ID NO: 5653 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
utacgacaaagaagatcauguag

SEQ ID NO: 5654 - RNA, 23 nt, Artificial Sequence
  source: /note="Description of Artificial Sequence: Synthetic oligonucleotide"
ucaguuuggauguuucagaagaa

SEQ ID NO: 5655 - RNA, 23 nt, Artificial Sequence
  source: /note="Description of Artificial Sequence: Synthetic oligonucleotide"
ucuaaacuuaaagucacaauaag

SEQ ID NO: 5656 - RNA, 23 nt, Artificial Sequence
  source: /note="Description of Artificial Sequence: Synthetic oligonucleotide"
uagaauuuuaaggagaaggugac

SEQ ID NO: 5657 - RNA, 23 nt, Artificial Sequence
  source: /note="Description of Artificial Sequence: Synthetic oligonucleotide"
ucacuaaacuuaaagucacaaua

SEQ ID NO: 5658 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
utcacuacgacaaagaagaucau

SEQ ID NO: 5659 - RNA, 23 nt, Artificial Sequence
  source: /note="Description of Artificial Sequence: Synthetic oligonucleotide"
ugaccaaauuuccuauagcaagu

SEQ ID NO: 5660 - RNA, 23 nt, Artificial Sequence
  source: /note="Description of Artificial Sequence: Synthetic oligonucleotide"
ucuacgacaaagaagaucaugua

SEQ ID NO: 5661 - RNA, 23 nt, Artificial Sequence
  source: /note="Description of Artificial Sequence: Synthetic oligonucleotide"
ugcaaacuagguaacuaucaaaa

SEQ ID NO: 5662 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugugaatucuccuacacagaagc

SEQ ID NO: 5663 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uagaccaaauutccuauagcaag

SEQ ID NO: 5664 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugugaatucuccuacacagaagc

SEQ ID NO: 5665 - RNA, 23 nt, Artificial Sequence
  source: /note="Description of Artificial Sequence: Synthetic oligonucleotide"
uugcaaacuagguaacuaucaaa

SEQ ID NO: 5666 - RNA, 23 nt, Artificial Sequence
  source: /note="Description of Artificial Sequence: Synthetic oligonucleotide"
ucgaaagauuuguguucaaaccu

SEQ ID NO: 5667 - RNA, 23 nt, Artificial Sequence
  source: /note="Description of Artificial Sequence: Synthetic oligonucleotide"
ugaacgaagagaauccaucuccc

SEQ ID NO: 5668 - RNA, 23 nt, Artificial Sequence
  source: /note="Description of Artificial Sequence: Synthetic oligonucleotide"
uacuacgacaaagaagaucaugu

SEQ ID NO: 5669 - RNA, 23 nt, Artificial Sequence
  source: /note="Description of Artificial Sequence: Synthetic oligonucleotide"
ugucuaauuuuacuucaagcuua

SEQ ID NO: 5670 - RNA, 23 nt, Artificial Sequence
  source: /note="Description of Artificial Sequence: Synthetic oligonucleotide"
uaucacuacgacaaagaagauca

SEQ ID NO: 5671 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucactacgacaaagaagaucaug

SEQ ID NO: 5672 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucggcaaauucagtctcagaucc

SEQ ID NO: 5673 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uacuacgacaaagaagaucaugu

SEQ ID NO: 5674 - RNA, 23 nt, Artificial Sequence
  source: /note="Description of Artificial Sequence: Synthetic oligonucleotide"
ucaugacaguaggaacacuugaa

SEQ ID NO: 5675 - RNA, 23 nt, Artificial Sequence
  source: /note="Description of Artificial Sequence: Synthetic oligonucleotide"
uacguaagguuuguuucacauaa

SEQ ID NO: 5676 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucagtaaaaguguactcgacauu

SEQ ID NO: 5677 - RNA, 23 nt, Artificial Sequence
  source: /note="Description of Artificial Sequence: Synthetic oligonucleotide"
ugaaaagugaauucuccuacaca

SEQ ID NO: 5678 - RNA, 23 nt, Artificial Sequence
  source: /note="Description of Artificial Sequence: Synthetic oligonucleotide"
ugagauaggaacuacaacgccuu

SEQ ID NO: 5679 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucuaaacuuaaagtcacaauaag

SEQ ID NO: 5680 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucactaaacuuaaagtcacaaua

SEQ ID NO: 5681 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugcuaagaagaaatuguguuguu

SEQ ID NO: 5682 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uacggaagauugututcccuuug

SEQ ID NO: 5683 - RNA, 23 nt, Artificial Sequence
  source: /note="Description of Artificial Sequence: Synthetic oligonucleotide"
ucaguaaaaguguacucgacauu

SEQ ID NO: 5684 - RNA, 23 nt, Artificial Sequence
  source: /note="Description of Artificial Sequence: Synthetic oligonucleotide"
uucacuacgacaaagaagaucau

SEQ ID NO: 5685 - RNA, 23 nt, Artificial Sequence
  source: /note="Description of Artificial Sequence: Synthetic oligonucleotide"
uauuucgaaaacauuuaugcuuc

SEQ ID NO: 5686 - RNA, 23 nt, Artificial Sequence
  source: /note="Description of Artificial Sequence: Synthetic oligonucleotide"
ucguaagguuuguuucacauaau

SEQ ID NO: 5687 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugaaaagugaatucuccuacaca

SEQ ID NO: 5688 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucuacgacaaagaagaucaugua

SEQ ID NO: 5689 - RNA, 23 nt, Artificial Sequence
  source: /note="Description of Artificial Sequence: Synthetic oligonucleotide"
ugugaauucuccuacacagaagc

SEQ ID NO: 5690 - RNA, 23 nt, Artificial Sequence
  source: /note="Description of Artificial Sequence: Synthetic oligonucleotide"
uguaauugcaagaucuacaaaag

SEQ ID NO: 5691 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucagtaaaaguguacucgacauu

SEQ ID NO: 5692 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucagtaaaaguguacucgacg

SEQ ID NO: 5693 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucuacgacaaagaagaucaugug

SEQ ID NO: 5694 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uugaaatggaagauuguuuuccc

SEQ ID NO: 5695 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uugaaacggaagauuguuuuccc

SEQ ID NO: 5696 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uuugaaacggaagauuguuuucc

SEQ ID NO: 5697 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uuugaaacggaagauuguuuucc

SEQ ID NO: 5698 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uaautctccuacacagaagccuc

SEQ ID NO: 5699 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugugaauucuccuacacagaagc

SEQ ID NO: 5700 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uaaaagtgaautcuccuacacgg

SEQ ID NO: 5701 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugaaaaaugaatucuccuacacg

SEQ ID NO: 5702 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucgaagaaaagugaauucuccug

SEQ ID NO: 5703 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucgaagaaaagtgaauucuccug

SEQ ID NO: 5704 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucgaaaacauuuaugcuucaggu

SEQ ID NO: 5705 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uucgaaaacautuaugcuucagg

SEQ ID NO: 5706 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uuucgaaaacauuuaugcuucag

SEQ ID NO: 5707 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uuucgaaaacatuuaugcuucag

SEQ ID NO: 5708 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uuuucgaaaacauuuaugcuucg

SEQ ID NO: 5709 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uauutcgaaaacauuuaugcuuc

SEQ ID NO: 5710 - RNA, 23 nt, Artificial Sequence
  source: /note="Description of Artificial Sequence: Synthetic oligonucleotide"
uauuucgaaaacauuuaugcuuc

SEQ ID NO: 5711 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uauutcgaaaacauuuaugcuuc

SEQ ID NO: 5712 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uauutcaaaaacauuuaugcuuc

SEQ ID NO: 5713 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uauutcgaaaacauuuaugcucc

SEQ ID NO: 5714 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uauutcgaaaacauuuaugcu

SEQ ID NO: 5715 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uauutcgaaaacauuuaugcuuc

SEQ ID NO: 5716 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uaautucgaaaacauuuaugcuu

SEQ ID NO: 5717 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uugaautucgaaaacauuuaugc

SEQ ID NO: 5718 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uugaautucgaaaacauuuaugu

SEQ ID NO: 5719 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugugaatuucgaaaacauuuaug

SEQ ID NO: 5720 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uacgacaaagaagaucauguagg

SEQ ID NO: 5721 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucuacgacaaagaagaucaugug

SEQ ID NO: 5722 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucuacgacaaagaagaucaugug

SEQ ID NO: 5723 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uacuacgacaaagaagaucaugu

SEQ ID NO: 5724 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucactacgacaaagaagaucaug

SEQ ID NO: 5725 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uucacuacgacaaagaagauc

SEQ ID NO: 5726 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uucacuacgacaaagaagauc

SEQ ID NO: 5727 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uucacuacgacaaagaagaucgu

SEQ ID NO: 5728 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uucacuacgacaaagaagaucgu

SEQ ID NO: 5729 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uucacuacgacaaagaagaucgu

SEQ ID NO: 5730 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugaaaatcacuacgacaaagagg

SEQ ID NO: 5731 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uugcaagaucuacaaaaggaucc

SEQ ID NO: 5732 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uauugcaagaucuacaaaagggu

SEQ ID NO: 5733 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uaautgcaagaucuacaaaaggg

SEQ ID NO: 5734 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uuaatugcaagaucuacaaaagg

SEQ ID NO: 5735 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uuaatugcaagaucuacaaagcc

SEQ ID NO: 5736 - RNA, 23 nt, Artificial Sequence
  source: /note="Description of Artificial Sequence: Synthetic oligonucleotide"
uguaauugcaagaucuacaaagg

SEQ ID NO: 5737 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uguaautgcaagaucuacaaagg

SEQ ID NO: 5738 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uguaautgcaagaucuacaaagg

SEQ ID NO: 5739 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugguaauugcaagaucuacaagg

SEQ ID NO: 5740 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uaugguaauugcaagaucuacgg

SEQ ID NO: 5741 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uaagguuuguutcacauaauuug

SEQ ID NO: 5742 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uuaaggtuugutucacauaauuu

SEQ ID NO: 5743 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uguaagguuuguuucacauaauu

SEQ ID NO: 5744 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucuacgacaaagaagaucaugug

SEQ ID NO: 5745 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uugaaatggaagauuguuuuccc

SEQ ID NO: 5746 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uugaaacggaagauuguuuuccc

SEQ ID NO: 5747 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uuugaaacggaagauuguuuucc

SEQ ID NO: 5748 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uaautctccuacacagaagccuc

SEQ ID NO: 5749 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uaaaagtgaautcuccuacacgg

SEQ ID NO: 5750 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucgaagaaaagtgaauucuccug

SEQ ID NO: 5751 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uucgaaaacautuaugcuucagg

SEQ ID NO: 5752 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uuucgaaaacatuuaugcuucag

SEQ ID NO: 5753 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uuuucgaaaacauuuaugcuucg

SEQ ID NO: 5754 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uauutcgaaaacauuuaugcuuc

SEQ ID NO: 5755 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uauutcgaaaacauuuaugcuuc

SEQ ID NO: 5756 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugugaatuucgaaaacauuuaug

SEQ ID NO: 5757 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucuacgacaaagaagaucaugug

SEQ ID NO: 5758 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uacuacgacaaagaagaucaugu

SEQ ID NO: 5759 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucactacgacaaagaagaucaug

SEQ ID NO: 5760 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uucacuacgacaaagaagaucgu

SEQ ID NO: 5761 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uucacuacgacaaagaagaucgu

SEQ ID NO: 5762 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uucacuacgacaaagaagaucgu

SEQ ID NO: 5763 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugaaaatcacuacgacaaagagg

SEQ ID NO: 5764 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uauugcaagaucuacaaaagggu

SEQ ID NO: 5765 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uguaautgcaagaucuacaaagg

SEQ ID NO: 5766 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uaugguaauugcaagaucuacgg

SEQ ID NO: 5767 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uaagguuuguutcacauaauuug

SEQ ID NO: 5768 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uuaaggtuugutucacauaauuu

SEQ ID NO: 5769 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uguaagguuuguuucacauaauu

SEQ ID NO: 5770 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uaugguaauugcaagaucuacgg

SEQ ID NO: 5771 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uaagguuuguutcacauaauuug

SEQ ID NO: 5772 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uuaaggtuugutucacauaauuu

SEQ ID NO: 5773 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uguaagguuuguuucacauaauu

SEQ ID NO: 5774 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucuacgacaaagaagaucaugug

SEQ ID NO: 5775 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uugaaatggaagauuguuuuccc

SEQ ID NO: 5776 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uugaaacggaagauuguuuuccc

SEQ ID NO: 5777 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uuugaaacggaagauuguuuucc

SEQ ID NO: 5778 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uaautctccuacacagaagccuc

SEQ ID NO: 5779 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uaaaagtgaautcuccuacacgg

SEQ ID NO: 5780 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucgaagaaaagtgaauucuccug

SEQ ID NO: 5781 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uucgaaaacautuaugcuucagg

SEQ ID NO: 5782 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uuucgaaaacatuuaugcuucag

SEQ ID NO: 5783 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uuuucgaaaacauuuaugcuucg

SEQ ID NO: 5784 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uauutcgaaaacauuuaugcuuc

SEQ ID NO: 5785 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uauutcgaaaacauuuaugcuuc

SEQ ID NO: 5786 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugugaatuucgaaaacauuuaug

SEQ ID NO: 5787 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucuacgacaaagaagaucaugug

SEQ ID NO: 5788 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uacuacgacaaagaagaucaugu

SEQ ID NO: 5789 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucactacgacaaagaagaucaug

SEQ ID NO: 5790 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uucacuacgacaaagaagaucgu

SEQ ID NO: 5791 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uucacuacgacaaagaagaucgu

SEQ ID NO: 5792 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uucacuacgacaaagaagaucgu

SEQ ID NO: 5793 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugaaaatcacuacgacaaagagg

SEQ ID NO: 5794 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uauugcaagaucuacaaaagggu

SEQ ID NO: 5795 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uguaautgcaagaucuacaaagg

SEQ ID NO: 5796 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uaugguaauugcaagaucuacgg

SEQ ID NO: 5797 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uaagguuuguutcacauaauuug

SEQ ID NO: 5798 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uuaaggtuugutucacauaauuu

SEQ ID NO: 5799 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uguaagguuuguuucacauaauu

SEQ ID NO: 5800 - RNA, 21 nt, Artificial Sequence
  source: /note="Description of Artificial Sequence: Synthetic oligonucleotide"
ugucgaguacacuuuuacuga

SEQ ID NO: 5801 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucagtaaaaguguactcgacauu

SEQ ID NO: 5802 - RNA, 21 nt, Artificial Sequence
  source: /note="Description of Artificial Sequence: Synthetic oligonucleotide"
cacaaagggaaaacaaucuua

SEQ ID NO: 5803 - RNA, 21 nt, Artificial Sequence
  source: /note="Description of Artificial Sequence: Synthetic oligonucleotide"
acaaagggaaaacaaucuuca

SEQ ID NO: 5804 - RNA, 19 nt, Artificial Sequence
  source: /note="Description of Artificial Sequence: Synthetic oligonucleotide"
ucugaaaguucgaagagcu

SEQ ID NO: 5805 - RNA, 19 nt, Artificial Sequence
  source: /note="Description of Artificial Sequence: Synthetic oligonucleotide"
cucuucgaacuuucagagu

SEQ ID NO: 5806 - RNA, 19 nt, Artificial Sequence
  source: /note="Description of Artificial Sequence: Synthetic oligonucleotide"
acucugaaaguucgaagag

SEQ ID NO: 5807 - RNA, 19 nt, Artificial Sequence
  source: /note="Description of Artificial Sequence: Synthetic oligonucleotide"
cuucgaacuuucagaguau

SEQ ID NO: 5808 - RNA, 19 nt, Artificial Sequence
  source: /note="Description of Artificial Sequence: Synthetic oligonucleotide"
auacucugaaaguucgaag

SEQ ID NO: 5809 - RNA, 19 nt, Artificial Sequence
  source: /note="Description of Artificial Sequence: Synthetic oligonucleotide"
uccugacuguguucugucu

SEQ ID NO: 5810 - RNA, 19 nt, Artificial Sequence
  source: /note="Description of Artificial Sequence: Synthetic oligonucleotide"
agacagaacacagucagga

SEQ ID NO: 5811 - RNA, 19 nt, Artificial Sequence
  source: /note="Description of Artificial Sequence: Synthetic oligonucleotide"
cugacuguguucugucuga

SEQ ID NO: 5812 - RNA, 19 nt, Artificial Sequence
  source: /note="Description of Artificial Sequence: Synthetic oligonucleotide"
ucagacagaacacagucag

SEQ ID NO: 5813 - RNA, 19 nt, Artificial Sequence
  source: /note="Description of Artificial Sequence: Synthetic oligonucleotide"
ugacuguguucugucugag

SEQ ID NO: 5814 - RNA, 19 nt, Artificial Sequence
  source: /note="Description of Artificial Sequence: Synthetic oligonucleotide"
gagaaggugacaucuuccu

SEQ ID NO: 5815 - RNA, 19 nt, Artificial Sequence
  source: /note="Description of Artificial Sequence: Synthetic oligonucleotide"
gauaaaaagucacaaguag

SEQ ID NO: 5816 - RNA, 21 nt, Artificial Sequence
  source: /note="Description of Artificial Sequence: Synthetic oligonucleotide"
ggcguuguaguuccuaucuca

SEQ ID NO: 5817 - RNA, 21 nt, Artificial Sequence
  source: /note="Description of Artificial Sequence: Synthetic oligonucleotide"
uucuguguaggagaauucaca

SEQ ID NO: 5818 - RNA, 21 nt, Artificial Sequence
  source: /note="Description of Artificial Sequence: Synthetic oligonucleotide"
ugguuucagcacagauucaga

SEQ ID NO: 5819 - RNA, 21 nt, Artificial Sequence
  source: /note="Description of Artificial Sequence: Synthetic oligonucleotide"
uguaggagaauucacuuuuca

SEQ ID NO: 5820 - RNA, 21 nt, Artificial Sequence
  source: /note="Description of Artificial Sequence: Synthetic oligonucleotide"
uuuguagaucuugcaauuaca

SEQ ID NO: 5821 - RNA, 21 nt, Artificial Sequence
  source: /note="Description of Artificial Sequence: Synthetic oligonucleotide"
guuugaacacaaaucuuucga

SEQ ID NO: 5822 - RNA, 21 nt, Artificial Sequence
  source: /note="Description of Artificial Sequence: Synthetic oligonucleotide"
cuucugaaacauccaaacuga

SEQ ID NO: 5823 - RNA, 21 nt, Artificial Sequence
  source: /note="Description of Artificial Sequence: Synthetic oligonucleotide"
agucaaguuccaaaucguuca

SEQ ID NO: 5824 - RNA, 21 nt, Artificial Sequence
  source: /note="Description of Artificial Sequence: Synthetic oligonucleotide"
gaucuucuuugucguagugaa

SEQ ID NO: 5825 - RNA, 21 nt, Artificial Sequence
  source: /note="Description of Artificial Sequence: Synthetic oligonucleotide"
ugucgaguacacuuuuacuga

SEQ ID NO: 5826 - RNA, 21 nt, Artificial Sequence
  source: /note="Description of Artificial Sequence: Synthetic oligonucleotide"
caugaucuucuuugucguaga

SEQ ID NO: 5827 - RNA, 21 nt, Artificial Sequence
  source: /note="Description of Artificial Sequence: Synthetic oligonucleotide"
aagggaaaacaaucuuccgua

SEQ ID NO: 5828 - RNA, 21 nt, Artificial Sequence
  source: /note="Description of Artificial Sequence: Synthetic oligonucleotide"
agauggauucucuucguucaa

SEQ ID NO: 5829 - RNA, 21 nt, Artificial Sequence
  source: /note="Description of Artificial Sequence: Synthetic oligonucleotide"
ugauaguuaccuaguuugcaa

SEQ ID NO: 5830 - RNA, 21 nt, Artificial Sequence
  source: /note="Description of Artificial Sequence: Synthetic oligonucleotide"
uauauuuuacaacauccguua

SEQ ID NO: 5831 - RNA, 21 nt, Artificial Sequence
  source: /note="Description of Artificial Sequence: Synthetic oligonucleotide"
uugcuauaggaaauuugguca

SEQ ID NO: 5832 - RNA, 21 nt, Artificial Sequence
  source: /note="Description of Artificial Sequence: Synthetic oligonucleotide"
aucuucuuugucguagugaua

SEQ ID NO: 5833 - RNA, 21 nt, Artificial Sequence
  source: /note="Description of Artificial Sequence: Synthetic oligonucleotide"
aucguaagagaacucuguaga

SEQ ID NO: 5834 - RNA, 21 nt, Artificial Sequence
  source: /note="Description of Artificial Sequence: Synthetic oligonucleotide"
gcguuguaguuccuaucucca

SEQ ID NO: 5835 - RNA, 21 nt, Artificial Sequence
  source: /note="Description of Artificial Sequence: Synthetic oligonucleotide"
augaucuucuuugucguagua

SEQ ID NO: 5836 - RNA, 21 nt, Artificial Sequence
  source: /note="Description of Artificial Sequence: Synthetic oligonucleotide"
gcuguuuacauaggauucuua

SEQ ID NO: 5837 - RNA, 21 nt, Artificial Sequence
  source: /note="Description of Artificial Sequence: Synthetic oligonucleotide"
caccuucuccuuaaaauucua

SEQ ID NO: 5838 - RNA, 21 nt, Artificial Sequence
  source: /note="Description of Artificial Sequence: Synthetic oligonucleotide"
uugugacuuuaaguuuaguga

SEQ ID NO: 5839 - RNA, 21 nt, Artificial Sequence
  source: /note="Description of Artificial Sequence: Synthetic oligonucleotide"
ucuuuauaccaucuuagguua

SEQ ID NO: 5840 - RNA, 21 nt, Artificial Sequence
  source: /note="Description of Artificial Sequence: Synthetic oligonucleotide"
gagauggauucucuucguuca

SEQ ID NO: 5841 - RNA, 21 nt, Artificial Sequence
  source: /note="Description of Artificial Sequence: Synthetic oligonucleotide"
uugauaguuaccuaguuugca

SEQ ID NO: 5842 - RNA, 21 nt, Artificial Sequence
  source: /note="Description of Artificial Sequence: Synthetic oligonucleotide"
gacagagaugaugauuuacua

SEQ ID NO: 5843 - RNA, 21 nt, Artificial Sequence
  source: /note="Description of Artificial Sequence: Synthetic oligonucleotide"
auguacagagguuauucuaua

SEQ ID NO: 5844 - RNA, 21 nt, Artificial Sequence
  source: /note="Description of Artificial Sequence: Synthetic oligonucleotide"
auguuucuagcugauuugaua

SEQ ID NO: 5845 - RNA, 21 nt, Artificial Sequence
  source: /note="Description of Artificial Sequence: Synthetic oligonucleotide"
caacacaauuucuucuuagca

SEQ ID NO: 5846 - RNA, 21 nt, Artificial Sequence
  source: /note="Description of Artificial Sequence: Synthetic oligonucleotide"
gcaagucaaguuccaaaucga

SEQ ID NO: 5847 - RNA, 21 nt, Artificial Sequence
  source: /note="Description of Artificial Sequence: Synthetic oligonucleotide"
aaugucggacuugguuaccua

SEQ ID NO: 5848 - RNA, 21 nt, Artificial Sequence
  source: /note="Description of Artificial Sequence: Synthetic oligonucleotide"
caucuguuggaauauucuaca

SEQ ID NO: 5849 - RNA, 21 nt, Artificial Sequence
  source: /note="Description of Artificial Sequence: Synthetic oligonucleotide"
uggaauauucuacuuuguuaa

SEQ ID NO: 5850 - RNA, 21 nt, Artificial Sequence
  source: /note="Description of Artificial Sequence: Synthetic oligonucleotide"
cugauaauagucucuuaaaca

SEQ ID NO: 5851 - RNA, 21 nt, Artificial Sequence
  source: /note="Description of Artificial Sequence: Synthetic oligonucleotide"
uuggcagaaacccugauuaua

SEQ ID NO: 5852 - RNA, 21 nt, Artificial Sequence
  source: /note="Description of Artificial Sequence: Synthetic oligonucleotide"
gcaaaggucacaauuuccuca

SEQ ID NO: 5853 - RNA, 21 nt, Artificial Sequence
  source: /note="Description of Artificial Sequence: Synthetic oligonucleotide"
cugaaccuaugaauuccgaua

SEQ ID NO: 5854 - RNA, 21 nt, Artificial Sequence
  source: /note="Description of Artificial Sequence: Synthetic oligonucleotide"
ggaagaaagguucaugucuga

SEQ ID NO: 5855 - RNA, 21 nt, Artificial Sequence
  source: /note="Description of Artificial Sequence: Synthetic oligonucleotide"
agccuguuggaaauagguuua

SEQ ID NO: 5856 - RNA, 21 nt, Artificial Sequence
  source: /note="Description of Artificial Sequence: Synthetic oligonucleotide"
uuauugcaucacuuguauaca

SEQ ID NO: 5857 - RNA, 21 nt, Artificial Sequence
  source: /note="Description of Artificial Sequence: Synthetic oligonucleotide"
cuguuggaaauagguuuugaa

SEQ ID NO: 5858 - RNA, 21 nt, Artificial Sequence
  source: /note="Description of Artificial Sequence: Synthetic oligonucleotide"
aucugagacugaauuugccga

SEQ ID NO: 5859 - RNA, 21 nt, Artificial Sequence
  source: /note="Description of Artificial Sequence: Synthetic oligonucleotide"
agcgugcuuauagacguuaca

SEQ ID NO: 5860 - RNA, 21 nt, Artificial Sequence
  source: /note="Description of Artificial Sequence: Synthetic oligonucleotide"
ccuuccugauaugcaguuaga

SEQ ID NO: 5861 - RNA, 21 nt, Artificial Sequence
  source: /note="Description of Artificial Sequence: Synthetic oligonucleotide"
guagaaaacuuuuacaucuga

SEQ ID NO: 5862 - RNA, 21 nt, Artificial Sequence
  source: /note="Description of Artificial Sequence: Synthetic oligonucleotide"
gcccaaaauacugauaauaga

SEQ ID NO: 5863 - RNA, 21 nt, Artificial Sequence
  source: /note="Description of Artificial Sequence: Synthetic oligonucleotide"
gucuuuacuggaaucuuugca

SEQ ID NO: 5864 - RNA, 21 nt, Artificial Sequence
  source: /note="Description of Artificial Sequence: Synthetic oligonucleotide"
agcuugaaguaaaauuagaca

SEQ ID NO: 5865 - RNA, 21 nt, Artificial Sequence
  source: /note="Description of Artificial Sequence: Synthetic oligonucleotide"
uggauucucuucguucacaga

SEQ ID NO: 5866 - RNA, 21 nt, Artificial Sequence
  source: /note="Description of Artificial Sequence: Synthetic oligonucleotide"
uuuaguggcaaacacucuuga

SEQ ID NO: 5867 - RNA, 21 nt, Artificial Sequence
  source: /note="Description of Artificial Sequence: Synthetic oligonucleotide"
acaugaucuucuuugucguaa

SEQ ID NO: 5868 - RNA, 21 nt, Artificial Sequence
  source: /note="Description of Artificial Sequence: Synthetic oligonucleotide"
caucuuuucacaggauuguaa

SEQ ID NO: 5869 - RNA, 21 nt, Artificial Sequence
  source: /note="Description of Artificial Sequence: Synthetic oligonucleotide"
cugauuuccuaagaaagguga

SEQ ID NO: 5870 - RNA, 21 nt, Artificial Sequence
  source: /note="Description of Artificial Sequence: Synthetic oligonucleotide"
cuuuauaccaucuuagguuca

SEQ ID NO: 5871 - RNA, 21 nt, Artificial Sequence
  source: /note="Description of Artificial Sequence: Synthetic oligonucleotide"
cgugcuuauagacguuaccga

SEQ ID NO: 5872 - RNA, 21 nt, Artificial Sequence
  source: /note="Description of Artificial Sequence: Synthetic oligonucleotide"
aagucaaguuccaaaucguua

SEQ ID NO: 5873 - RNA, 21 nt, Artificial Sequence
  source: /note="Description of Artificial Sequence: Synthetic oligonucleotide"
cugaauauacaaguauuagga

SEQ ID NO: 5874 - RNA, 21 nt, Artificial Sequence
  source: /note="Description of Artificial Sequence: Synthetic oligonucleotide"
ucguggcuccuuguuuucuga

SEQ ID NO: 5875 - RNA, 21 nt, Artificial Sequence
  source: /note="Description of Artificial Sequence: Synthetic oligonucleotide"
agacguuaccgcuuaaggcaa

SEQ ID NO: 5876 - RNA, 21 nt, Artificial Sequence
  source: /note="Description of Artificial Sequence: Synthetic oligonucleotide"
ucaucuuuucacaggauugua

SEQ ID NO: 5877 - RNA, 21 nt, Artificial Sequence
  source: /note="Description of Artificial Sequence: Synthetic oligonucleotide"
uuuuacaucugccuugucaua

SEQ ID NO: 5878 - RNA, 21 nt, Artificial Sequence
  source: /note="Description of Artificial Sequence: Synthetic oligonucleotide"
cuuccugauaugcaguuagua

SEQ ID NO: 5879 - RNA, 21 nt, Artificial Sequence
  source: /note="Description of Artificial Sequence: Synthetic oligonucleotide"
ugaauauacaaguauuaggaa

SEQ ID NO: 5880 - RNA, 21 nt, Artificial Sequence
  source: /note="Description of Artificial Sequence: Synthetic oligonucleotide"
guuucuagcugauuugauuga

SEQ ID NO: 5881 - RNA, 21 nt, Artificial Sequence
  source: /note="Description of Artificial Sequence: Synthetic oligonucleotide"
ugccacugaagaaaguacuga

SEQ ID NO: 5882 - RNA, 21 nt, Artificial Sequence
  source: /note="Description of Artificial Sequence: Synthetic oligonucleotide"
ugaucuucuuugucguaguga

SEQ ID NO: 5883 - RNA, 21 nt, Artificial Sequence
  source: /note="Description of Artificial Sequence: Synthetic oligonucleotide"
ucauccuggaaguucaguuga

SEQ ID NO: 5884 - RNA, 21 nt, Artificial Sequence
  source: /note="Description of Artificial Sequence: Synthetic oligonucleotide"
auguauauuugaccuagugaa

SEQ ID NO: 5885 - RNA, 21 nt, Artificial Sequence
  source: /note="Description of Artificial Sequence: Synthetic oligonucleotide"
augucgaguacacuuuuacua

SEQ ID NO: 5886 - RNA, 21 nt, Artificial Sequence
  source: /note="Description of Artificial Sequence: Synthetic oligonucleotide"
uauugugacuuuaaguuuaga

SEQ ID NO: 5887 - RNA, 21 nt, Artificial Sequence
  source: /note="Description of Artificial Sequence: Synthetic oligonucleotide"
guauguuucuagcugauuuga

SEQ ID NO: 5888 - RNA, 21 nt, Artificial Sequence
  source: /note="Description of Artificial Sequence: Synthetic oligonucleotide"
gggagauggauucucuucgua

SEQ ID NO: 5889 - RNA, 21 nt, Artificial Sequence
  source: /note="Description of Artificial Sequence: Synthetic oligonucleotide"
uuccugauaugcaguuaguua

SEQ ID NO: 5890 - RNA, 21 nt, Artificial Sequence
  source: /note="Description of Artificial Sequence: Synthetic oligonucleotide"
caacuuacuuuccuaaauuaa

SEQ ID NO: 5891 - RNA, 21 nt, Artificial Sequence
  source: /note="Description of Artificial Sequence: Synthetic oligonucleotide"
ugcuauaggaaauuuggucua

SEQ ID NO: 5892 - RNA, 21 nt, Artificial Sequence
  source: /note="Description of Artificial Sequence: Synthetic oligonucleotide"
cuaaauuauggaaguaaucua

SEQ ID NO: 5893 - RNA, 21 nt, Artificial Sequence
  source: /note="Description of Artificial Sequence: Synthetic oligonucleotide"
gacuuaccuuuagaguauuga

SEQ ID NO: 5894 - RNA, 21 nt, Artificial Sequence
  source: /note="Description of Artificial Sequence: Synthetic oligonucleotide"
cggacuugguuaccuaucuca

SEQ ID NO: 5895 - RNA, 21 nt, Artificial Sequence
  source: /note="Description of Artificial Sequence: Synthetic oligonucleotide"
agucaccacucagcauucgua

SEQ ID NO: 5896 - RNA, 21 nt, Artificial Sequence
  source: /note="Description of Artificial Sequence: Synthetic oligonucleotide"
uugcccuuaugaauguuagua

SEQ ID NO: 5897 - RNA, 21 nt, Artificial Sequence
  source: /note="Description of Artificial Sequence: Synthetic oligonucleotide"
cuuuucacaggauuguaauua

SEQ ID NO: 5898 - RNA, 21 nt, Artificial Sequence
  source: /note="Description of Artificial Sequence: Synthetic oligonucleotide"
gcugaaccuaugaauuccgaa

SEQ ID NO: 5899 - RNA, 21 nt, Artificial Sequence
  source: /note="Description of Artificial Sequence: Synthetic oligonucleotide"
cuucuuagccuuguuuaggca

SEQ ID NO: 5900 - RNA, 21 nt, Artificial Sequence
  source: /note="Description of Artificial Sequence: Synthetic oligonucleotide"
cugccaaguuaacauagagua

SEQ ID NO: 5901 - RNA, 21 nt, Artificial Sequence
  source: /note="Description of Artificial Sequence: Synthetic oligonucleotide"
uguagaucuugcaauuaccaa

SEQ ID NO: 5902 - RNA, 21 nt, Artificial Sequence
  source: /note="Description of Artificial Sequence: Synthetic oligonucleotide"
uaggcuaaugacccaagauua

SEQ ID NO: 5903 - RNA, 21 nt, Artificial Sequence
  source: /note="Description of Artificial Sequence: Synthetic oligonucleotide"
uuugucguagugauuuuccua

SEQ ID NO: 5904 - RNA, 21 nt, Artificial Sequence
  source: /note="Description of Artificial Sequence: Synthetic oligonucleotide"
uugcaagccucuuaugugaga

SEQ ID NO: 5905 - RNA, 23 nt, Artificial Sequence
  source: /note="Description of Artificial Sequence: Synthetic oligonucleotide"
ugagauaggaacuacaacgccuu

SEQ ID NO: 5906 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugugaatucuccuacacagaagc

SEQ ID NO: 5907 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucugaatcugugcugaaaccaca

SEQ ID NO: 5908 - RNA, 23 nt, Artificial Sequence
  source: /note="Description of Artificial Sequence: Synthetic oligonucleotide"
ugaaaagugaauucuccuacaca

SEQ ID NO: 5909 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uguaautgcaagaucuacaaaag

SEQ ID NO: 5910 - RNA, 23 nt, Artificial Sequence
  source: /note="Description of Artificial Sequence: Synthetic oligonucleotide"
ucgaaagauuuguguucaaaccu

SEQ ID NO: 5911 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucaguutggauguuucagaagaa

SEQ ID NO: 5912 - RNA, 23 nt, Artificial Sequence
  source: /note="Description of Artificial Sequence: Synthetic oligonucleotide"
ugaacgauuuggaacuugacuug

SEQ ID NO: 5913 - RNA, 23 nt, Artificial Sequence
  source: /note="Description of Artificial Sequence: Synthetic oligonucleotide"
uucacuacgacaaagaagaucau

SEQ ID NO: 5914 - RNA, 23 nt, Artificial Sequence
  source: /note="Description of Artificial Sequence: Synthetic oligonucleotide"
ucaguaaaaguguacucgacauu

SEQ ID NO: 5915 - RNA, 23 nt, Artificial Sequence
  source: /note="Description of Artificial Sequence: Synthetic oligonucleotide"
ucuacgacaaagaagaucaugua

SEQ ID NO: 5916 - RNA, 23 nt, Artificial Sequence
  source: /note="Description of Artificial Sequence: Synthetic oligonucleotide"
uacggaagauuguuuucccuuug

SEQ ID NO: 5917 - RNA, 23 nt, Artificial Sequence
  source: /note="Description of Artificial Sequence: Synthetic oligonucleotide"
uugaacgaagagaauccaucucc

SEQ ID NO: 5918 - RNA, 23 nt, Artificial Sequence
  source: /note="Description of Artificial Sequence: Synthetic oligonucleotide"
uugcaaacuagguaacuaucaaa

SEQ ID NO: 5919 - RNA, 23 nt, Artificial Sequence
  source: /note="Description of Artificial Sequence: Synthetic oligonucleotide"
uaacggauguuguaaaauauauc

SEQ ID NO: 5920 - RNA, 23 nt, Artificial Sequence
  source: /note="Description of Artificial Sequence: Synthetic oligonucleotide"
ugaccaaauuuccuauagcaagu

SEQ ID NO: 5921 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uaucactacgacaaagaagauca

SEQ ID NO: 5922 - RNA, 23 nt, Artificial Sequence
  source: /note="Description of Artificial Sequence: Synthetic oligonucleotide"
ucuacagaguucucuuacgauuc

SEQ ID NO: 5923 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uggagataggaacuacaacgccu

SEQ ID NO: 5924 - RNA, 23 nt, Artificial Sequence
  source: /note="Description of Artificial Sequence: Synthetic oligonucleotide"
uacuacgacaaagaagaucaugu

SEQ ID NO: 5925 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uaagaatccuauguaaacagcuu

SEQ ID NO: 5926 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uagaautuuaaggagaaggugac

SEQ ID NO: 5927 - RNA, 23 nt, Artificial Sequence
  source: /note="Description of Artificial Sequence: Synthetic oligonucleotide"
ucacuaaacuuaaagucacaaua

SEQ ID NO: 5928 - RNA, 23 nt, Artificial Sequence
  source: /note="Description of Artificial Sequence: Synthetic oligonucleotide"
uaaccuaagaugguauaaagaau

SEQ ID NO: 5929 - RNA, 23 nt, Artificial Sequence
  source: /note="Description of Artificial Sequence: Synthetic oligonucleotide"
ugaacgaagagaauccaucuccc

SEQ ID NO: 5930 - RNA, 23 nt, Artificial Sequence
  source: /note="Description of Artificial Sequence: Synthetic oligonucleotide"
ugcaaacuagguaacuaucaaaa

SEQ ID NO: 5931 - RNA, 23 nt, Artificial Sequence
  source: /note="Description of Artificial Sequence: Synthetic oligonucleotide"
uaguaaaucaucaucucugucuc

SEQ ID NO: 5932 - RNA, 23 nt, Artificial Sequence
  source: /note="Description of Artificial Sequence: Synthetic oligonucleotide"
uauagaauaaccucuguacauug

SEQ ID NO: 5933 - RNA, 23 nt, Artificial Sequence
  source: /note="Description of Artificial Sequence: Synthetic oligonucleotide"
uaucaaaucagcuagaaacauac

SEQ ID NO: 5934 - RNA, 23 nt, Artificial Sequence
  source: /note="Description of Artificial Sequence: Synthetic oligonucleotide"
ugcuaagaagaaauuguguuguu

SEQ ID NO: 5935 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucgauutggaacuugacuugcag

SEQ ID NO: 5936 - RNA, 23 nt, Artificial Sequence
  source: /note="Description of Artificial Sequence: Synthetic oligonucleotide"
uagguaaccaaguccgacauuau

SEQ ID NO: 5937 - RNA, 23 nt, Artificial Sequence
  source: /note="Description of Artificial Sequence: Synthetic oligonucleotide"
uguagaauauuccaacagauggg

SEQ ID NO: 5938 - RNA, 23 nt, Artificial Sequence
  source: /note="Description of Artificial Sequence: Synthetic oligonucleotide"
uuaacaaaguagaauauuccaac

SEQ ID NO: 5939 - RNA, 23 nt, Artificial Sequence
  source: /note="Description of Artificial Sequence: Synthetic oligonucleotide"
uguuuaagagacuauuaucagua

SEQ ID NO: 5940 - RNA, 23 nt, Artificial Sequence
  source: /note="Description of Artificial Sequence: Synthetic oligonucleotide"
uauaaucaggguuucugccaauu

SEQ ID NO: 5941 - RNA, 23 nt, Artificial Sequence
  source: /note="Description of Artificial Sequence: Synthetic oligonucleotide"
ugaggaaauugugaccuuugcuc

SEQ ID NO: 5942 - RNA, 23 nt, Artificial Sequence
  source: /note="Description of Artificial Sequence: Synthetic oligonucleotide"
uaucggaauucauagguucagcc

SEQ ID NO: 5943 - RNA, 23 nt, Artificial Sequence
  source: /note="Description of Artificial Sequence: Synthetic oligonucleotide"
ucagacaugaaccuuucuuccau

SEQ ID NO: 5944 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uaaacctauuuccaacaggcuug

SEQ ID NO: 5945 - RNA, 23 nt, Artificial Sequence
  source: /note="Description of Artificial Sequence: Synthetic oligonucleotide"
uguauacaagugaugcaauaaau

SEQ ID NO: 5946 - RNA, 23 nt, Artificial Sequence
  source: /note="Description of Artificial Sequence: Synthetic oligonucleotide"
uucaaaaccuauuuccaacaggc

SEQ ID NO: 5947 - RNA, 23 nt, Artificial Sequence
  source: /note="Description of Artificial Sequence: Synthetic oligonucleotide"
ucggcaaauucagucucagaucc

SEQ ID NO: 5948 - RNA, 23 nt, Artificial Sequence
  source: /note="Description of Artificial Sequence: Synthetic oligonucleotide"
uguaacgucuauaagcacgcuga

SEQ ID NO: 5949 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucuaactgcauaucaggaaggau

SEQ ID NO: 5950 - RNA, 23 nt, Artificial Sequence
  source: /note="Description of Artificial Sequence: Synthetic oligonucleotide"
ucagauguaaaaguuuucuacau

SEQ ID NO: 5951 - RNA, 23 nt, Artificial Sequence
  source: /note="Description of Artificial Sequence: Synthetic oligonucleotide"
ucuauuaucaguauuuugggcag

SEQ ID NO: 5952 - RNA, 23 nt, Artificial Sequence
  source: /note="Description of Artificial Sequence: Synthetic oligonucleotide"
ugcaaagauuccaguaaagacca

SEQ ID NO: 5953 - RNA, 23 nt, Artificial Sequence
  source: /note="Description of Artificial Sequence: Synthetic oligonucleotide"
ugucuaauuuuacuucaagcuua

SEQ ID NO: 5954 - RNA, 23 nt, Artificial Sequence
  source: /note="Description of Artificial Sequence: Synthetic oligonucleotide"
ucugugaacgaagagaauccauc

SEQ ID NO: 5955 - RNA, 23 nt, Artificial Sequence
  source: /note="Description of Artificial Sequence: Synthetic oligonucleotide"
ucaagaguguuugccacuaaagu

SEQ ID NO: 5956 - RNA, 23 nt, Artificial Sequence
  source: /note="Description of Artificial Sequence: Synthetic oligonucleotide"
uuacgacaaagaagaucauguag

SEQ ID NO: 5957 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uuacaatccugugaaaagaugac

SEQ ID NO: 5958 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucaccutucuuaggaaaucagag

SEQ ID NO: 5959 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugaacctaagaugguauaaagaa

SEQ ID NO: 5960 - RNA, 23 nt, Artificial Sequence
  source: /note="Description of Artificial Sequence: Synthetic oligonucleotide"
ucgguaacgucuauaagcacgcu

SEQ ID NO: 5961 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uaacgatuuggaacuugacuugc

SEQ ID NO: 5962 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uccuaatacuuguauauucagcc

SEQ ID NO: 5963 - RNA, 23 nt, Artificial Sequence
  source: /note="Description of Artificial Sequence: Synthetic oligonucleotide"
ucagaaaacaaggagccacgaau

SEQ ID NO: 5964 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uugccutaagcgguaacgucuau

SEQ ID NO: 5965 - RNA, 23 nt, Artificial Sequence
  source: /note="Description of Artificial Sequence: Synthetic oligonucleotide"
uacaauccugugaaaagaugaca

SEQ ID NO: 5966 - RNA, 23 nt, Artificial Sequence
  source: /note="Description of Artificial Sequence: Synthetic oligonucleotide"
uaugacaaggcagauguaaaagu

SEQ ID NO: 5967 - RNA, 23 nt, Artificial Sequence
  source: /note="Description of Artificial Sequence: Synthetic oligonucleotide"
uacuaacugcauaucaggaagga

SEQ ID NO: 5968 - RNA, 23 nt, Artificial Sequence
  source: /note="Description of Artificial Sequence: Synthetic oligonucleotide"
uuccuaauacuuguauauucagc

SEQ ID NO: 5969 - RNA, 23 nt, Artificial Sequence
  source: /note="Description of Artificial Sequence: Synthetic oligonucleotide"
ucaaucaaaucagcuagaaacau

SEQ ID NO: 5970 - RNA, 23 nt, Artificial Sequence
  source: /note="Description of Artificial Sequence: Synthetic oligonucleotide"
ucaguacuuucuucaguggcaac

SEQ ID NO: 5971 - RNA, 23 nt, Artificial Sequence
  source: /note="Description of Artificial Sequence: Synthetic oligonucleotide"
ucacuacgacaaagaagaucaug

SEQ ID NO: 5972 - RNA, 23 nt, Artificial Sequence
  source: /note="Description of Artificial Sequence: Synthetic oligonucleotide"
ucaacugaacuuccaggaugaac

SEQ ID NO: 5973 - RNA, 23 nt, Artificial Sequence
  source: /note="Description of Artificial Sequence: Synthetic oligonucleotide"
uucacuaggucaaauauacaucc

SEQ ID NO: 5974 - RNA, 23 nt, Artificial Sequence
  source: /note="Description of Artificial Sequence: Synthetic oligonucleotide"
uaguaaaaguguacucgacauuu

SEQ ID NO: 5975 - RNA, 23 nt, Artificial Sequence
  source: /note="Description of Artificial Sequence: Synthetic oligonucleotide"
ucuaaacuuaaagucacaauaag

SEQ ID NO: 5976 - RNA, 23 nt, Artificial Sequence
  source: /note="Description of Artificial Sequence: Synthetic oligonucleotide"
ucaaaucagcuagaaacauaccu

SEQ ID NO: 5977 - RNA, 23 nt, Artificial Sequence
  source: /note="Description of Artificial Sequence: Synthetic oligonucleotide"
uacgaagagaauccaucucccca

SEQ ID NO: 5978 - RNA, 23 nt, Artificial Sequence
  source: /note="Description of Artificial Sequence: Synthetic oligonucleotide"
uaacuaacugcauaucaggaagg

SEQ ID NO: 5979 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uuaauutaggaaaguaaguuggu

SEQ ID NO: 5980 - RNA, 23 nt, Artificial Sequence
  source: /note="Description of Artificial Sequence: Synthetic oligonucleotide"
uagaccaaauuuccuauagcaag

SEQ ID NO: 5981 - RNA, 23 nt, Artificial Sequence
  source: /note="Description of Artificial Sequence: Synthetic oligonucleotide"
uagauuacuuccauaauuuagga

SEQ ID NO: 5982 - RNA, 23 nt, Artificial Sequence
  source: /note="Description of Artificial Sequence: Synthetic oligonucleotide"
ucaauacucuaaagguaagucuu

SEQ ID NO: 5983 - RNA, 23 nt, Artificial Sequence
  source: /note="Description of Artificial Sequence: Synthetic oligonucleotide"
ugagauagguaaccaaguccgac

SEQ ID NO: 5984 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uacgaatgcugaguggugacuga

SEQ ID NO: 5985 - RNA, 23 nt, Artificial Sequence
  source: /note="Description of Artificial Sequence: Synthetic oligonucleotide"
uacuaacauucauaagggcaaaa

SEQ ID NO: 5986 - RNA, 23 nt, Artificial Sequence
  source: /note="Description of Artificial Sequence: Synthetic oligonucleotide"
uaauuacaauccugugaaaagau

SEQ ID NO: 5987 - RNA, 23 nt, Artificial Sequence
  source: /note="Description of Artificial Sequence: Synthetic oligonucleotide"
uucggaauucauagguucagccu

SEQ ID NO: 5988 - RNA, 23 nt, Artificial Sequence
  source: /note="Description of Artificial Sequence: Synthetic oligonucleotide"
ugccuaaacaaggcuaagaaggc

SEQ ID NO: 5989 - RNA, 23 nt, Artificial Sequence
  source: /note="Description of Artificial Sequence: Synthetic oligonucleotide"
uacucuauguuaacuuggcagca

SEQ ID NO: 5990 - RNA, 23 nt, Artificial Sequence
  source: /note="Description of Artificial Sequence: Synthetic oligonucleotide"
uugguaauugcaagaucuacaaa

SEQ ID NO: 5991 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uaaucutgggucauuagccuaaa

SEQ ID NO: 5992 - RNA, 23 nt, Artificial Sequence
  source: /note="Description of Artificial Sequence: Synthetic oligonucleotide"
uaggaaaaucacuacgacaaaga

SEQ ID NO: 5993 - RNA, 23 nt, Artificial Sequence
  source: /note="Description of Artificial Sequence: Synthetic oligonucleotide"
ucucacauaagaggcuugcaacc

SEQ ID NO: 5994 - RNA, 21 nt, Artificial Sequence
  source: /note="Description of Artificial Sequence: Synthetic oligonucleotide"
ggcguuguaguuccuaucuca

SEQ ID NO: 5995 - RNA, 21 nt, Artificial Sequence
  source: /note="Description of Artificial Sequence: Synthetic oligonucleotide"
uucuguguaggagaauucaca

SEQ ID NO: 5996 - RNA, 21 nt, Artificial Sequence
  source: /note="Description of Artificial Sequence: Synthetic oligonucleotide"
ugucgaguacacuuuuacuga

SEQ ID NO: 5997 - RNA, 23 nt, Artificial Sequence
  source: /note="Description of Artificial Sequence: Synthetic oligonucleotide"
ucaguaaaaguguacucgacauu

SEQ ID NO: 5998 - RNA, 21 nt, Artificial Sequence
  source: /note="Description of Artificial Sequence: Synthetic oligonucleotide"
ugucgaguacacuuuuacuga

SEQ ID NO: 5999 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucagtaaaaguguacucgacauu

SEQ ID NO: 6000 - RNA, 19 nt, Artificial Sequence
  source: /note="Description of Artificial Sequence: Synthetic oligonucleotide"
ucgaguacacuuuuacuga

SEQ ID NO: 6001 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucagtaaaaguguacucgacg

SEQ ID NO: 6002 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uguaggagaatucacuuuuca

SEQ ID NO: 6003 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugaaaagugaatucuccuacaca

SEQ ID NO: 6004 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uguaggagaauucacuuuuca

SEQ ID NO: 6005 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugaaaagugaatucuccuacacg

SEQ ID NO: 6006 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aagggaaaacaaucuuccgua

SEQ ID NO: 6007 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uacggaagauugututcccuuug

SEQ ID NO: 6008 - RNA, 21 nt, Artificial Sequence
  source: /note="Description of Artificial Sequence: Synthetic oligonucleotide"
aagggaaaacaaucuuccgua

SEQ ID NO: 6009 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uacggaagauuguuutcccuuug

SEQ ID NO: 6010 - RNA, 21 nt, Artificial Sequence
  source: /note="Description of Artificial Sequence: Synthetic oligonucleotide"
agggaaaacaaucuuccguua

SEQ ID NO: 6011 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uaacggaagauuguuuucccuuu

SEQ ID NO: 6012 - RNA, 21 nt, Artificial Sequence
  source: /note="Description of Artificial Sequence: Synthetic oligonucleotide"
gaaaacaaucuuccguuucaa

SEQ ID NO: 6013 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uugaaacggaagauuguuuuccc

SEQ ID NO: 6014 - RNA, 21 nt, Artificial Sequence
  source: /note="Description of Artificial Sequence: Synthetic oligonucleotide"
aaaacaaucuuccguuucaaa

SEQ ID NO: 6015 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uuugaaacggaagauuguuuucc

SEQ ID NO: 6016 - RNA, 21 nt, Artificial Sequence
  source: /note="Description of Artificial Sequence: Synthetic oligonucleotide"
agcauaaauguuuucgaaaua

SEQ ID NO: 6017 - RNA, 23 nt, Artificial Sequence
  source: /note="Description of Artificial Sequence: Synthetic oligonucleotide"
uauuucgaaaacauuuaugcuuc

SEQ ID NO: 6018 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gaagcauaaauguuuucgaaa

SEQ ID NO: 6019 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uuucgaaaacatuuaugcuucag

SEQ ID NO: 6020 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aagcauaaauguuuucgaaaa

SEQ ID NO: 6021 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uuuucgaaaacauuuaugcuucg

SEQ ID NO: 6022 - RNA, 21 nt, Artificial Sequence
  source: /note="Description of Artificial Sequence: Synthetic oligonucleotide"
agcauaaauguuuucgaaaua

SEQ ID NO: 6023 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uauutcgaaaacauuuaugcucc

SEQ ID NO: 6024 - RNA, 21 nt, Artificial Sequence
  source: /note="Description of Artificial Sequence: Synthetic oligonucleotide"
augaucuucuuugucguagua

SEQ ID NO: 6025 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uacuacgacaaagaagaucaugu

SEQ ID NO: 6026 - DNA, 19 bp, Artificial Sequence
  source: /note="Description of Artificial Sequence: Synthetic oligonucleotide"
  source: /note="Description of Combined DNA/RNA Molecule: Synthetic oligonucleotide"
ucuucuuugucguagugaa

SEQ ID NO: 6027 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uucacuacgacaaagaagauc

SEQ ID NO: 6028 - RNA, 21 nt, Artificial Sequence
  source: /note="Description of Artificial Sequence: Synthetic oligonucleotide"
gaucuucuuugucguagugaa

SEQ ID NO: 6029 - RNA, 23 nt, Artificial Sequence
  source: /note="Description of Artificial Sequence: Synthetic oligonucleotide"
uucacuacgacaaagaagaucau

SEQ ID NO: 6030 - RNA, 21 nt, Artificial Sequence
  source: /note="Description of Artificial Sequence: Synthetic oligonucleotide"
caaguguuccuacugucauga

SEQ ID NO: 6031 - RNA, 23 nt, Artificial Sequence
  source: /note="Description of Artificial Sequence: Synthetic oligonucleotide"
ucaugacaguaggaacacuugaa

SEQ ID NO: 6032 - RNA, 21 nt, Artificial Sequence
  source: /note="Description of Artificial Sequence: Synthetic oligonucleotide"
caaguguuccuacugucauga

SEQ ID NO: 6033 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucaugacaguaggaacacuugcc

SEQ ID NO: 6034 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
caacacaatutcuucuuagca

SEQ ID NO: 6035 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugcuaagaagaaatuguguuguu

SEQ ID NO: 6036 - RNA, 21 nt, Artificial Sequence
  source: /note="Description of Artificial Sequence: Synthetic oligonucleotide"
caacacaauuucuucuuagca

SEQ ID NO: 6037 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugcuaagaagaaauuguguuguu

SEQ ID NO: 6038 - RNA, 21 nt, Artificial Sequence
  source: /note="Description of Artificial Sequence: Synthetic oligonucleotide"
ugucgaguacacuuuuacuga

SEQ ID NO: 6039 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucagtaaaaguguactcgacauu

SEQ ID NO: 6040 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uucuguguaggagaauucaca

SEQ ID NO: 6041 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugugaauucuccuacacagaagc

SEQ ID NO: 6042 - RNA, 21 nt, Artificial Sequence
  source: /note="Description of Artificial Sequence: Synthetic oligonucleotide"
auaaauguuuucgaaauucaa

SEQ ID NO: 6043 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uugaautucgaaaacauuuaugu

SEQ ID NO: 6044 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gaucuucuuugucguagugaa

SEQ ID NO: 6045 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uucacuacgacaaagaagaucgu

SEQ ID NO: 6046 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gaucuucuuugucguagugaa

SEQ ID NO: 6047 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uucacuacgacaaagaagaucgu

SEQ ID NO: 6048 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
caugaucutctuugucguaga

SEQ ID NO: 6049 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucuacgacaaagaagaucaugua

SEQ ID NO: 6050 - RNA, 21 nt, Artificial Sequence
  source: /note="Description of Artificial Sequence: Synthetic oligonucleotide"
caugaucuucuuugucguaga

SEQ ID NO: 6051 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucuacgacaaagaagaucaugug

SEQ ID NO: 6052 - RNA, 21 nt, Artificial Sequence
  source: /note="Description of Artificial Sequence: Synthetic oligonucleotide"
uuuguagaucuugcaauuaca

SEQ ID NO: 6053 - RNA, 23 nt, Artificial Sequence
  source: /note="Description of Artificial Sequence: Synthetic oligonucleotide"
uguaauugcaagaucuacaaaag

SEQ ID NO: 6054 - RNA, 21 nt, Artificial Sequence
  source: /note="Description of Artificial Sequence: Synthetic oligonucleotide"
uuuuguagaucuugcaauuaa

SEQ ID NO: 6055 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uuaatugcaagaucuacaaagcc

SEQ ID NO: 6056 - RNA, 21 nt, Artificial Sequence
  source: /note="Description of Artificial Sequence: Synthetic oligonucleotide"
guagaucuugcaauuaccaua

SEQ ID NO: 6057 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uaugguaauugcaagaucuacgg

SEQ ID NO: 6058 - RNA, 21 nt, Artificial Sequence
  source: /note="Description of Artificial Sequence: Synthetic oligonucleotide"
uaugugaaacaaaccuuacga

SEQ ID NO: 6059 - RNA, 23 nt, Artificial Sequence
  source: /note="Description of Artificial Sequence: Synthetic oligonucleotide"
ucguaagguuuguuucacauaau

SEQ ID NO: 6060 - RNA, 21 nt, Artificial Sequence
  source: /note="Description of Artificial Sequence: Synthetic oligonucleotide"
uuaugugaaacaaaccuuaca

SEQ ID NO: 6061 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uguaagguuuguuucacauaauu

SEQ ID NO: 6062 - RNA, 21 nt, Artificial Sequence
  source: /note="Description of Artificial Sequence: Synthetic oligonucleotide"
uaugugaaacaaaccuuacga

SEQ ID NO: 6063 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucguaagguuuguuucacauagu

SEQ ID NO: 6064 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugucgaguacacuuuuacuga

SEQ ID NO: 6065 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucagtaaaaguguactcgacauu

SEQ ID NO: 6066 - RNA, 21 nt, Artificial Sequence
  source: /note="Description of Artificial Sequence: Synthetic oligonucleotide"
uucuguguaggagaauucaca

SEQ ID NO: 6067 - RNA, 23 nt, Artificial Sequence
  source: /note="Description of Artificial Sequence: Synthetic oligonucleotide"
ugugaauucuccuacacagaagc

SEQ ID NO: 6068 - RNA, 21 nt, Artificial Sequence
  source: /note="Description of Artificial Sequence: Synthetic oligonucleotide"
agcauaaauguuuucgaaaua

SEQ ID NO: 6069 - RNA, 23 nt, Artificial Sequence
  source: /note="Description of Artificial Sequence: Synthetic oligonucleotide"
uauuucgaaaacauuuaugcuuc

SEQ ID NO: 6070 - RNA, 21 nt, Artificial Sequence
  source: /note="Description of Artificial Sequence: Synthetic oligonucleotide"
gaucuucuuugucguagugaa

SEQ ID NO: 6071 - RNA, 23 nt, Artificial Sequence
  source: /note="Description of Artificial Sequence: Synthetic oligonucleotide"
uucacuacgacaaagaagaucau

SEQ ID NO: 6072 - RNA, 21 nt, Artificial Sequence
  source: /note="Description of Artificial Sequence: Synthetic oligonucleotide"
ugucgaguacacuuuuacuga

SEQ ID NO: 6073 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucagtaaaaguguactcgacauu

SEQ ID NO: 6074 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
caacacaatutcuucuuagca

SEQ ID NO: 6075 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugcuaagaagaaatuguguuguu

SEQ ID NO: 6076 - RNA, 21 nt, Artificial Sequence
  source: /note="Description of Artificial Sequence: Synthetic oligonucleotide"
aaaacaaucuuccguuucaaa

SEQ ID NO: 6077 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uuugaaacggaagauuguuuucc

SEQ ID NO: 6078 - RNA, 21 nt, Artificial Sequence
  source: /note="Description of Artificial Sequence: Synthetic oligonucleotide"
ugucgaguacacuuuuacuga

SEQ ID NO: 6079 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucagtaaaaguguactcgacauu

SEQ ID NO: 6080 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
caacacaatutcuucuuagca

SEQ ID NO: 6081 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugcuaagaagaaatuguguuguu

SEQ ID NO: 6082 - RNA, 21 nt, Artificial Sequence
  source: /note="Description of Artificial Sequence: Synthetic oligonucleotide"
aaaacaaucuuccguuucaaa

SEQ ID NO: 6083 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uuugaaacggaagauuguuuucc

We claim:

1. A double stranded ribonucleic acid (dsRNA) agent for inhibiting expression of sodium channel, voltage gated, type IX alpha subunit (SCN9A), wherein the dsRNA agent comprises a sense strand and an antisense strand forming a double stranded region, wherein the antisense strand comprises a nucleotide sequence comprising at least 17 contiguous nucleotides, with 0 or 1 mismatch, from the antisense sequence set forth as SEQ ID NO: 5093 and wherein the sense strand comprises a nucleotide sequence comprising at least 17 contiguous nucleotides, with 0 or 1 mismatch, from a sense sequence set forth as SEQ ID NO: 4827.

2. The dsRNA of claim 1, wherein the sense strand comprises the nucleotide sequence set forth as SEQ ID NO: 4827 and the antisense strand comprises the nucleotide sequence set forth as SEQ ID NO: 5093.

3. The dsRNA agent of claim 1, wherein at least one of the sense strand and the antisense strand is conjugated to one or more lipophilic moieties.

4. The dsRNA agent of claim 3, wherein the lipophilic moiety is conjugated to the dsRNA agent (i) via a carrier that replaces one or more nucleotide(s) in the internal position(s) or the double stranded region; or (ii) via a linker containing an ether, thioether, urea, carbonate, amine, amide, maleimide-thioether, disulfide, phosphodiester, sulfonamide linkage, a product of a click reaction, or carbamate.

5. The dsRNA agent of claim 1, wherein (a) the dsRNA agent comprises at least one modified nucleotide;

(b) no more than five of the sense strand nucleotides and not more than five of the nucleotides of the antisense strand are unmodified nucleotides; or (c) all of the nucleotides of the sense strand and all of the nucleotides of the antisense strand are modified nucleotides.

6. The dsRNA agent of claim 5, wherein at least one of the modified nucleotides is selected from the group consisting of a deoxy-nucleotide, a 3'-terminal deoxythimidine (dT) nucleotide, a 2'-O-methyl modified nucleotide, a 2'-fluoro modified nucleotide, a 2'-deoxy-modified nucleotide, a locked nucleotide, an unlocked nucleotide, a conformationally restricted nucleotide, a constrained ethyl nucleotide, an abasic nucleotide, a 2'-amino-modified nucleotide, a 2'-O-allyl-modified nucleotide, 2'-C-alkyl-modified nucleotide, a 2'-methoxyethyl modified nucleotide, a 2'-O-alkyl-modified nucleotide, a morpholino nucleotide, a phosphoramidate, a non-natural nucleotide base, a tetrahydropyran modified nucleotide, a 1,5-anhydrohexitol modified nucleotide, a cyclohexenyl modified nucleotide, a nucleotide comprising a phosphorothioate group, a nucleotide comprising a methylphosphonate group, a nucleotide comprising a 5'-phosphate, a nucleotide comprising a 5'-phosphate mimic, a glycol modified nucleotide, and a 2-O-(N-methylacetamide) modified nucleotide; and combinations thereof.

7. The dsRNA agent of claim 1, wherein (a) at least one strand comprises a 3' overhang of at least 2 nucleotides;

(b) the double stranded region is 15-30 nucleotide pairs in length;

(c) the double stranded region is 17-23 nucleotide pairs in length;

(d) each strand has 19-30 nucleotides; and/or (e) the dsRNA agent comprises at least one phosphorothioate or methylphosphonate internucleotide linkage.

8. The dsRNA agent of claim 3, wherein the dsRNA agent further comprises (a) a targeting ligand;

(b) a targeting ligand that targets a CNS tissue; or (c) a targeting ligand that targets a CNS tissue, wherein the CNS tissue is a brain tissue or a spinal tissue.

9. The dsRNA agent of claim 1, wherein the dsRNA agent comprises (a) a phosphate or phosphate mimic at the 5'-end of the antisense strand; or (b) a 5'-vinyl phosphonate (VP) at the 5'-end of the antisense strand.

10. The dsRNA agent of claim 1, wherein the sense strand comprises the modified sequence 5'-usgsucgaguAfCfAfcuuu(Uhd)acugaL96-3' (SEQ ID NO: 4029), and the antisense strand comprises the modified sequence 5'-VPusCfsagd-TadAaagudGuAfcdTegacasusu-3' (SEQ ID NO: 4295), wherein a, c, g, and u are 2'-O-methyl (2'-OMe) A, C, G, and U, respectively;

Af and Cf is 2'-deoxy-2'-fluoro (2'-F) A and U, respectively;

s is a phosphorothioate linkage;

dT, dA, and dG is 2'-deoxythymidine, 2'-deoxyadenosine-3'-phosphate, and 2'-deoxyguanosine-3'-phosphate, respectively;

Uhd is 2'-O-hexadecyl-uridine-3'-phosphate;

VP is vinyl phosphonate; and

L96 is N-[tris(GalNAc-alkyl)-amidodecanoyl)]-4-hydroxyprolinol Hyp-(GalNAc-alkyl) 3.

11. An isolated cell containing the dsRNA agent of claim 1.

12. A pharmaceutical composition for inhibiting expression of a SCN9A, comprising the dsRNA agent of claim 1.

13. A method of inhibiting expression of SCN9A in a cell, the method comprising:

(a) introducing into the cell the dsRNA agent of claim 1; and (b) maintaining the cell produced in step (a) for a time sufficient to reduce levels of SCN9A mRNA, SCN9A protein, or both of SCN9A mRNA and protein, thereby inhibiting expression of SCN9A in the cell.

14. A method of treating a subject having or diagnosed with having a SCN9A-associated disorder, wherein the SCN9A-associated disorder is pain associated with primary erythromelalgia (PE) or paroxysmal extreme pain disorder (PEPD), comprising administering to the subject a therapeutically effective amount of the dsRNA agent of claim 1, thereby treating the disorder.

15. The method of claim 14, wherein treating comprises amelioration of at least one sign or symptom of the disorder PE or PEPD in the subject; and/or the treating comprises (a) reducing pain in the subject; or (b) inhibiting or reducing the expression or activity of SCN9A in the subject.

16. The method of claim 14 wherein (a) the dsRNA agent is administered to the subject intracranially, intrathecally, intraventricularly, or intracerebrally; and/or (b) the method further comprises administering to the subject an additional agent or therapy suitable for treatment or prevention of PE or PEPD.

17. The dsRNA agent of claim 3, wherein (a) the one or more lipophilic moieties are conjugated via a linker or carrier;

(b) the one or more lipophilic moieties are conjugated to one or more internal positions on at least one strand;

(c) the one or more lipophilic moieties are conjugated to one or more internal positions on at least one strand via a linker or carrier;

(d) the one or more lipophilic moieties are an aliphatic, alicyclic, or polyalicyclic compound;

(e) the one or more lipophilic moieties contain a saturated or unsaturated C16 hydrocarbon chain; and/or (f) the one or more lipophilic moieties are conjugated to a nucleobase, sugar moiety, or internucleosidic linkage.

18. The method of claim 13, wherein (a) the cell is within a non-human subject; or (b) the cell is within a human subject.

* * * * *